US010563211B2

(12) United States Patent
Keasling et al.

(10) Patent No.: US 10,563,211 B2
(45) Date of Patent: Feb. 18, 2020

(54) RECOMBINANT MICROORGANISMS AND METHODS FOR PRODUCING CANNABINOIDS AND CANNABINOID DERIVATIVES

(71) Applicant: The Regents of the University of California, Oakland, CA (US)

(72) Inventors: Jay D. Keasling, Berkeley, CA (US); Leo D'Espaux, San Francisco, CA (US); Jeff Wong, Berkeley, CA (US); Xiaozhou Luo, Berkeley, CA (US); Michael Reiter, Berkeley, CA (US); Charles Denby, Berkeley, CA (US); Anna Lechner, Berkeley, CA (US)

(73) Assignee: The Regents of the University of California, Oakland, CA (US)

( * ) Notice: Subject to any disclaimer, the term of this patent is extended or adjusted under 35 U.S.C. 154(b) by 0 days.

(21) Appl. No.: 16/408,492

(22) Filed: May 10, 2019

(65) Prior Publication Data

US 2019/0300888 A1    Oct. 3, 2019

Related U.S. Application Data

(63) Continuation of application No. PCT/US2018/029668, filed on Apr. 27, 2018.

(60) Provisional application No. 62/569,532, filed on Oct. 7, 2017, provisional application No. 62/491,114, filed on Apr. 27, 2017.

(51) Int. Cl.
| | |
|---|---|
| *C12N 15/81* | (2006.01) |
| *C12N 15/82* | (2006.01) |
| *C12N 15/70* | (2006.01) |
| *C07C 63/04* | (2006.01) |
| *C12N 9/10* | (2006.01) |
| *C12P 7/42* | (2006.01) |
| *C12N 15/52* | (2006.01) |

(52) U.S. Cl.
CPC .............. *C12N 15/81* (2013.01); *C07C 63/04* (2013.01); *C12N 9/1085* (2013.01); *C12N 15/70* (2013.01); *C12N 15/8243* (2013.01); *C12P 7/42* (2013.01); *C12N 15/52* (2013.01); *C12Y 101/01088* (2013.01); *C12Y 203/01086* (2013.01); *C12Y 203/01206* (2015.07); *C12Y 203/0301* (2013.01); *C12Y 205/01102* (2015.07); *C12Y 207/01036* (2013.01); *C12Y 207/04002* (2013.01); *C12Y 401/01033* (2013.01); *C12Y 503/03002* (2013.01); *C12Y 602/01003* (2013.01); *C12Y 604/01002* (2013.01)

(58) Field of Classification Search
None
See application file for complete search history.

(56) References Cited

U.S. PATENT DOCUMENTS

| | | |
|---|---|---|
| 7,659,097 B2 | 2/2010 | Renninger et al. |
| 8,884,100 B2 | 11/2014 | Page et al. |
| 8,999,682 B2 | 4/2015 | Hahn et al. |
| 9,359,625 B2 | 6/2016 | Winnicki et al. |
| 9,394,510 B2 | 7/2016 | Peet et al. |
| 9,546,362 B2 | 1/2017 | Page et al. |
| 9,611,460 B2 | 4/2017 | Page et al. |
| 9,822,384 B2 | 11/2017 | Poulos et al. |
| 10,059,971 B2 | 8/2018 | Page et al. |
| 10,093,949 B2 | 10/2018 | Poulos et al. |
| 10,106,822 B2 | 10/2018 | Renninger et al. |
| 2012/0144523 A1 | 6/2012 | Page et al. |
| 2014/0141476 A1 | 5/2014 | Page et al. |
| 2014/0271940 A1 | 9/2014 | Wurzer |
| 2014/0273109 A1 | 9/2014 | Smolke et al. |
| 2016/0010126 A1 | 1/2016 | Poulos et al. |
| 2016/0040190 A1 | 2/2016 | Renninger et al. |
| 2016/0298151 A1 | 10/2016 | Butt et al. |
| 2016/0346339 A1 | 12/2016 | Finley et al. |
| 2017/0211049 A1 | 7/2017 | Page et al. |
| 2018/0073043 A1 | 3/2018 | Poulos et al. |
| 2018/0155748 A1 | 6/2018 | Butt et al. |

FOREIGN PATENT DOCUMENTS

| | | |
|---|---|---|
| EP | 3 067 058 A1 | 9/2016 |
| WO | WO-2017/139496 A1 | 8/2017 |
| WO | WO-2018/148848 A1 | 8/2018 |
| WO | WO-2018/148849 A1 | 8/2018 |
| WO | WO-2019/014490 A1 | 1/2019 |
| WO | WO 2019/071000 | 4/2019 |

OTHER PUBLICATIONS

Chica et al. Curr Opin Biotechnol. Aug. 2005;16(4):378-84. (Year: 2005).*
Singh et al. Curr Protein Pept Sci. 2017, 18, 1-11 (Year: 2017).*
Hsu et al., "Addition of Autotrophic Carbon Fixation Pathways to Increase the Theoretical Heterotrophic Yield of Acetate", The Fourth International Conference on Computational Systems Biology (ISB2010), Suzhou, China, Sep. 9-11, 2010, pp. 314-322. (Year: 2010).*
Prather et al. Curr Opin Biotechnol. Oct. 2008;19(5):468-74. (Year: 2008).*
Andre, C.M. et al. (2016). "*Cannabis sativa*: The plant of the thousand and one molecules," Front Plant Sci. vol. 7, Article 19, pp. 1-17.
Brenneisen, R. (2007). Chapter 2: Chemistry and analysis of phytocannabinoids and other cannabis constituents, Forensic science and medicine: Marijuana and the cannabinoids, Humana Press, pp. 17-49.

(Continued)

*Primary Examiner* — Christian L Fronda
(74) *Attorney, Agent, or Firm* — Richard Aron Osman

(57) ABSTRACT

The present disclosure provides genetically modified host cells that produce a cannabinoid, a cannabinoid derivative, a cannabinoid precursor, or a cannabinoid precursor derivative. The present disclosure provides methods of synthesizing a cannabinoid, a cannabinoid derivative, a cannabinoid precursor, or a cannabinoid precursor derivative.

15 Claims, 101 Drawing Sheets

Specification includes a Sequence Listing.

(56) References Cited

OTHER PUBLICATIONS

Citti, C. et al. (2018). "Pharmaceutical and biomedical analysis of cannabinoids: A critical review," J. Pharm. Biomed. Anal. 147:565-579.

Daniel, B. et al. (2017). "The family of berberine bridge enzyme-like enzymes: A treasure-trove of oxidative reactions," Arch. Biochem. Biophys. 632:88-103.

European Nucleotide Archive (2011). TSA: "*Cannabis sativa* PK15523. 1-1.CasaPuKu mRNA sequence," XP002782462, Sequence: JP460119. 1, 2 total pages.

Flores-Sanchez, I.J. et al. (2008). "Secondary metabolism in cannabis," Phytochemistry Reviews 7:615-639.

Hussein, Sayed Hussein Farag, M.S.c. (2014). "Cannabinoids production in *Cannabis sativa* L.: An in vitro approach," von der Fakultat Bio- und Chemieingenieurwesen der Technischen Universitat Dortmund genehmigte Dissertation, located at: https://eldorado.tu-dortmund.de/bitstream/2003/34350/1/Dissertation.pdf, 138 total pages.

Hussein, Sayed Hussein Farag, M.S.c. (2014). "Cannabinoids production in *Cannabis sativa* L.: An in vitro approach," Dissertation, 146 total pages.

International Search Report dated Aug. 1, 2018, for PCT Application No. PCT/US2018/029668, filed on Apr. 27, 2018, 5 pages.

Marks, M.D. et al. (2009). "Identification of candidate genes affecting Delta9-tetrahydrocannabinol biosynthesis in *Cannabis sativa*," J. Exp. Bot. 60:3715-3726.

Onofri, C. et al. (2015). "Sequence heterogeneity of cannabidiolic- and tetrahydrocannabinolic acid-synthase in *Cannabis sativa* L. and its relationship with chemical phenotype," Phytochemistry 116:57-68.

Pamplaniyil, Kathleen, M. Sc. (2018). "Identification, isolation and functional characterization of prenyltransferases in *Cannabis sativa* L." Dissertation, with Eldorado full thesis details dated Jan. 17, 2018, 142 total pages.

Written Opinion of the International Searching Authority dated Aug. 1, 2018, for PCT Application No. PCT/US2018/029668, filed on Apr. 27, 2018, 5 pages.

Zirpel, B. et al. (2018). "Optimization of $\Delta^9$-tetrahydrocannabinolic acid synthase production in Komagataella phaffii via post-translational bottleneck identification," 272-273:40-47.

Zirpel, Bastian, M. Sc. (2018). "Recombinant expression and functional characterization of cannabinoid producing enzymes in Komagataella Phaffii," Dissertation, 178 total pages.

Degenhardt, Sara Friederike M.Sc. "Evaluation of C-prenylating enzymes for the heterologous biosynthesis of cannabigerolic acid." Dissertation, with Eldorado full thesis details dated Oct. 9, 2018. 180 pages.

Pamplaniyil, Kathleen, M. Sc. "Identification, isolation and functional characterization of prenyltransferases in *Cannnabis sativa* L." Public presentation of dissertation defense Mar. 6, 2017. Dissertation published Jan. 17, 2018.

* cited by examiner 1014a-cHexCoA 1114a-tCsPT4

511b-GAL1ps-CBDASt28-ENO2ts

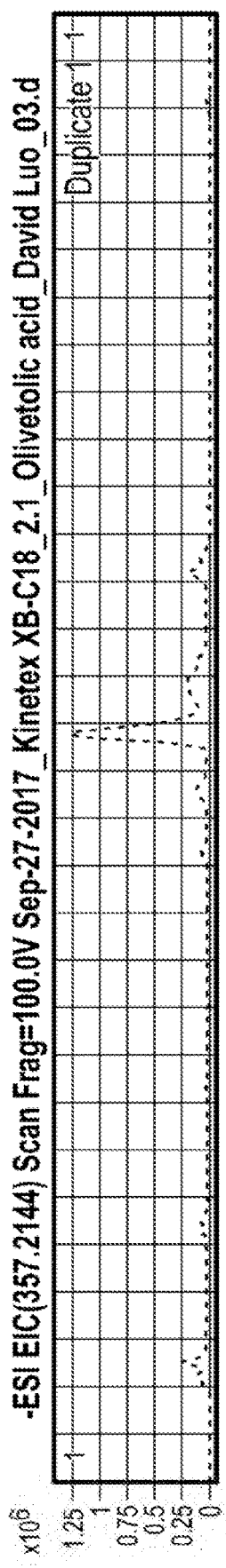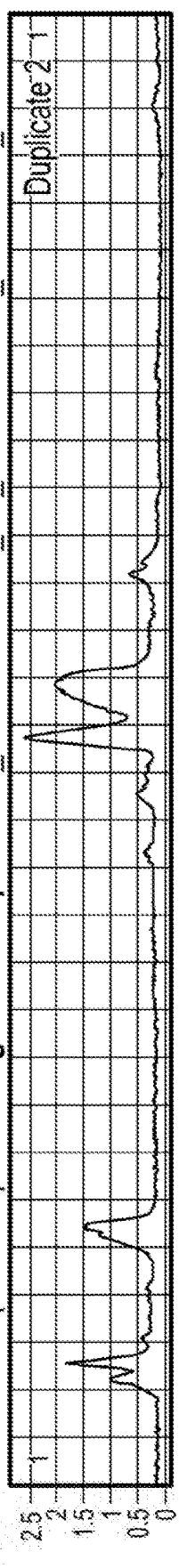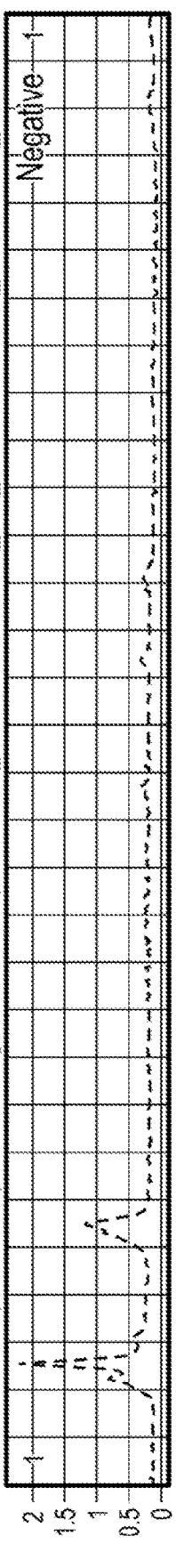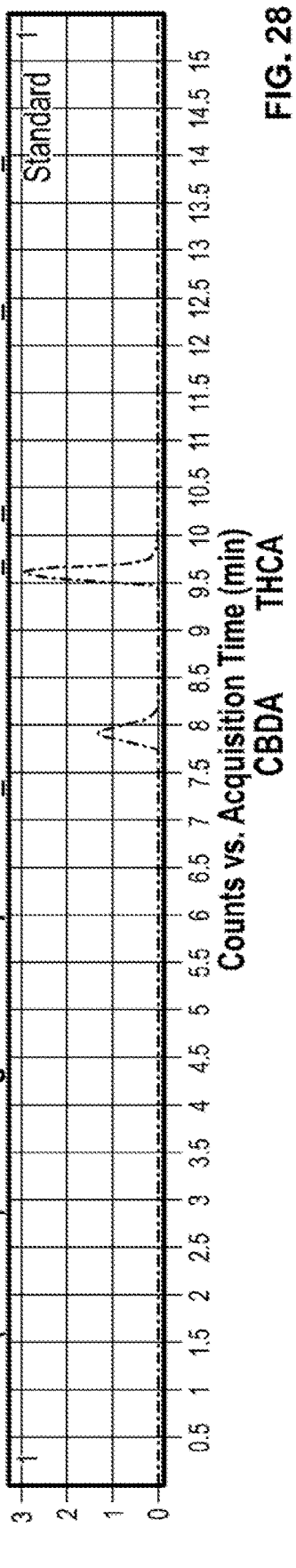
FIG. 28

RECOMBINANT MICROORGANISMS AND METHODS FOR PRODUCING CANNABINOIDS AND CANNABINOID DERIVATIVES

CROSS-REFERENCE TO RELATED APPLICATIONS

This application is a continuation application of International Application No. PCT/US2018/029668, filed Apr. 27, 2018, which claims the benefit of U.S. Provisional Application No. 62/491,114, filed Apr. 27, 2017, and U.S. Provisional Application No. 62/569,532, filed Oct. 7, 2017, the contents of which are incorporated herein by reference in their entirety.

STATEMENT REGARDING FEDERALLY SPONSORED RESEARCH

This invention was made with government support under Grant Numbers 1330914 and 1442724 awarded by the National Science Foundation. The government has certain rights in the invention.

REFERENCE TO A SEQUENCE LISTING

The Sequence Listing associated with this application is provided in text format in lieu of a paper copy, and is hereby incorporated by reference into the specification. The name of the text file containing the Sequence Listing is DEMT_001_02USSeqList_ST25_txt. The text file is about 673 KB, was created on Apr. 13, 2019, and is being submitted electronically via EFS-Web.

INTRODUCTION

Plants from the genus *Cannabis* have been used by humans for their medicinal properties for thousands of years. In modern times, the bioactive effects of *Cannabis* are attributed to a class of compounds termed "cannabinoids," of which there are hundreds of structural analogs including tetrahydrocannabinol (THC) and cannabidiol (CBD). These molecules and preparations of *Cannabis* material have recently found application as therapeutics for chronic pain, multiple sclerosis, cancer-associated nausea and vomiting, weight loss, appetite loss, spasticity, and other conditions.

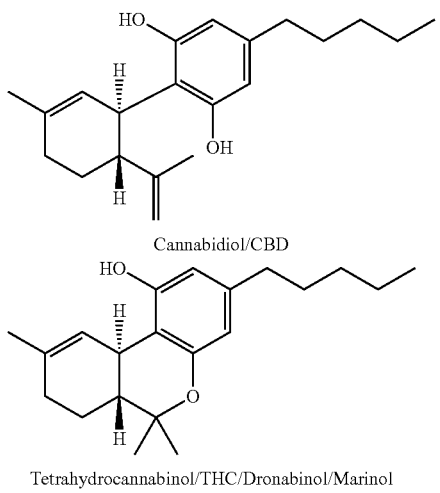

Cannabidiol/CBD

Tetrahydrocannabinol/THC/Dronabinol/Marinol

The physiological effects of certain cannabinoids are thought to be mediated by their interaction with two cellular receptors found in humans and other animals. Cannabinoid receptor type 1 (CB1) is common in the brain, the reproductive system, and the eye. Cannabinoid receptor type 2 (CB2) is common in the immune system and mediates therapeutic effects related to inflammation in animal models. The discovery of cannabinoid receptors and their interactions with plant-derived cannabinoids predated the identification of endogenous ligands.

Besides THC and CBD, hundreds of other cannabinoids have been identified in *Cannabis*. However, many of these compounds exist at low levels and alongside more abundant cannabinoids, making it difficult to obtain pure samples from plants to study their therapeutic potential. Similarly, methods of chemically synthesizing these types of products has been cumbersome and costly, and tends to produce insufficient yield. Accordingly, additional methods of making pure cannabinoids, cannabinoid precursors, cannabinoid derivatives, or cannabinoid precursor derivatives are needed.

SUMMARY

The present disclosure provides methods, polypeptides, nucleic acids encoding said polypeptides, and genetically modified host cells for the production of cannabinoids, cannabinoid derivatives, cannabinoid precursors, or cannabinoid precursor derivatives.

One aspect of the disclosure relates to a genetically modified host cell for producing a cannabinoid or a cannabinoid derivative, the genetically modified host cell comprising one or more heterologous nucleic acids encoding a geranyl pyrophosphate:olivetolic acid geranyltransferase (GOT) polypeptide, wherein said GOT polypeptide catalyzes production of cannabigerolic acid from geranyl pyrophosphate (GPP) and olivetolic acid in an amount at least ten times higher than a polypeptide comprising an amino acid sequence set forth in SEQ ID NO:82.

Another aspect of the disclosure relates to a genetically modified host cell for producing a cannabinoid or a cannabinoid derivative, the genetically modified host cell comprising one or more heterologous nucleic acids encoding a GOT polypeptide comprising an amino acid sequence having at least 65% sequence identity to SEQ ID NO:110.

One aspect of the disclosure relates to a genetically modified host cell for producing a cannabinoid or a cannabinoid derivative, the genetically modified host cell comprising one or more heterologous nucleic acids encoding a GOT polypeptide comprising an amino acid sequence having at least 65% sequence identity to SEQ ID NO:100.

In certain embodiments of any of the foregoing or following, the genetically modified host cell further comprises one or more heterologous nucleic acids encoding a tetraketide synthase (TKS) polypeptide and one or more heterologous nucleic acids encoding an olivetolic acid cyclase (OAC) polypeptide, or one or more heterologous nucleic acids encoding a fusion TKS and OAC polypeptide. In some embodiments, the TKS polypeptide comprises an amino acid sequence having at least 50% sequence identity to SEQ ID NO:11 or SEQ ID NO:76. In some embodiments, the OAC polypeptide comprises an amino acid sequence having at least 50% sequence identity to SEQ ID NO:10 or SEQ ID NO:78.

In certain embodiments of any of the foregoing or following, the genetically modified host cell further comprises one or more of the following: a) one or more heterologous nucleic acids encoding a polypeptide that generates an acyl-CoA compound or an acyl-CoA compound derivative; b) one or more heterologous nucleic acids encoding a polypeptide that generates GPP; or c) one or more heterologous nucleic acids encoding a polypeptide that generates malonyl-CoA. In some embodiments, the genetically modified host cell further comprises one or more heterologous nucleic acids encoding a polypeptide that generates an acyl-CoA compound or an acyl-CoA compound derivative, wherein the polypeptide that generates an acyl-CoA compound or an acyl-CoA compound derivative is an acyl-activating enzyme (AAE) polypeptide. In some embodiments, the AAE polypeptide comprises an amino acid sequence having at least 50% sequence identity to SEQ ID NO:90. In some embodiments, the AAE polypeptide comprises an amino acid sequence having at least 50% sequence identity to SEQ ID NO:92 or SEQ ID NO:149. In some embodiments, the genetically modified host cell further comprises one or more heterologous nucleic acids encoding a polypeptide that generates an acyl-CoA compound or an acyl-CoA compound derivative, wherein the polypeptide that generates an acyl-CoA compound or an acyl-CoA compound derivative is a fatty acyl-CoA ligase polypeptide. In some embodiments, the fatty acyl-CoA ligase polypeptide comprises an amino acid sequence having at least 50% sequence identity to SEQ ID NO:145 or SEQ ID NO:147. In some embodiments, the genetically modified host cell further comprises one or more heterologous nucleic acids encoding a polypeptide that generates an acyl-CoA compound or an acyl-CoA compound derivative, wherein the polypeptide that generates an acyl-CoA compound or an acyl-CoA compound derivative is a fatty acyl-CoA synthetase (FAA) polypeptide. In some embodiments, the FAA polypeptide comprises an amino acid sequence having at least 50% sequence identity to SEQ ID NO:169, SEQ ID NO:192, SEQ ID NO:194, SEQ ID NO:196, SEQ ID NO:198, or SEQ ID NO:200. In some embodiments, the genetically modified host cell further comprises one or more heterologous nucleic acids encoding a polypeptide that generates GPP, wherein the polypeptide that generates GPP is a geranyl pyrophosphate synthetase (GPPS) polypeptide. In some embodiments, the GPPS polypeptide comprises an amino acid sequence having at least 50% sequence identity to SEQ ID NO:7, SEQ ID NO:8, or SEQ ID NO:60. In some embodiments, the genetically modified host cell further comprises one or more heterologous nucleic acids encoding a polypeptide that generates malonyl-CoA, wherein the polypeptide that generates malonyl-CoA is an acetyl-CoA carboxylase-1 (ACC1) polypeptide. In some embodiments, the ACC1 polypeptide comprises an amino acid sequence having at least 50% sequence identity to SEQ ID NO:9, SEQ ID NO:97, or SEQ ID NO:207.

In certain embodiments of any of the foregoing or following, the genetically modified host cell further comprises one or more of the following: a) one or more heterologous nucleic acids encoding a HMG-CoA synthase (HMGS) polypeptide; b) one or more heterologous nucleic acids encoding a 3-hydroxy-3-methyl-glutaryl-CoA reductase (HMGR) polypeptide; c) one or more heterologous nucleic acids encoding a mevalonate kinase (MK) polypeptide; d) one or more heterologous nucleic acids encoding a phosphomevalonate kinase (PMK) polypeptide; e) one or more heterologous nucleic acids encoding a mevalonate pyrophosphate decarboxylase (MVD) polypeptide; or f) one or more heterologous nucleic acids encoding a isopentenyl diphosphate isomerase (IDI) polypeptide. In some embodiments, the genetically modified host cell further comprises one or more heterologous nucleic acids encoding an IDI polypeptide. In some embodiments, the IDI polypeptide comprises an amino acid sequence having at least 50% sequence identity to SEQ ID NO:58. In some embodiments, the genetically modified host cell further comprises one or more heterologous nucleic acids encoding an HMGR polypeptide. In some embodiments, the HMGR polypeptide comprises an amino acid sequence having at least 50% sequence identity to SEQ ID NO:22. In some embodiments, the genetically modified host cell further comprises one or more heterologous nucleic acids encoding an HMGR polypeptide, wherein the HMGR polypeptide is a truncated HMGR (tHMGR) polypeptide. In some embodiments, the tHMGR polypeptide comprises an amino acid sequence having at least 50% sequence identity to SEQ ID NO:17, SEQ ID NO:52, SEQ ID NO:113, or SEQ ID NO:208. In some embodiments, the genetically modified host cell further comprises one or more heterologous nucleic acids encoding an HMGS polypeptide. In some embodiments, the HMGS polypeptide comprises an amino acid sequence having at least 50% sequence identity to SEQ ID NO:23, SEQ ID NO:24, or SEQ ID NO:115. In some embodiments, the genetically modified host cell further comprises one or more heterologous nucleic acids encoding an MK polypeptide. In some embodiments, the MK polypeptide comprises an amino acid sequence having at least 50% sequence identity to SEQ ID NO:64. In some embodiments, the genetically modified host cell further comprises one or more heterologous nucleic acids encoding a PMK polypeptide. In some embodiments, the PMK polypeptide comprises an amino acid sequence having at least 50% sequence identity to SEQ ID NO:62 or SEQ ID NO:205. In some embodiments, the genetically modified host cell further comprises one or more heterologous nucleic acids encoding a MVD polypeptide. In some embodiments, the MVD polypeptide comprises an amino acid sequence having at least 50% sequence identity to SEQ ID NO:66.

In certain embodiments of any of the foregoing or following, the genetically modified host cell further comprises one or more heterologous nucleic acids encoding a polypeptide that condenses two molecules of acetyl-CoA to generate acetoacetyl-CoA. In some embodiments, the polypeptide that condenses two molecules of acetyl-CoA to generate acetoacetyl-CoA is an acetoacetyl-CoA thiolase polypeptide. In some embodiments, the acetoacetyl-CoA thiolase polypeptide comprises an amino acid sequence having at least 50% sequence identity to SEQ ID NO:25.

In certain embodiments of any of the foregoing or following, the genetically modified host cell further comprises one or more heterologous nucleic acids encoding a pyruvate decarboxylase (PDC) polypeptide. In some embodiments, the PDC polypeptide comprises an amino acid sequence having at least 50% sequence identity to SEQ ID NO:117.

In certain embodiments of any of the foregoing or following, the genetically modified host cell is a eukaryotic cell. In some embodiments, the eukaryotic cell is a yeast cell. In some embodiments, the yeast cell is *Saccharomyces cerevisiae*. In some embodiments, the *Saccharomyces cerevisiae* is a protease-deficient strain of *Saccharomyces cerevisiae*. In some embodiments, the genetically modified host cell is a plant cell.

In certain embodiments of any of the foregoing or following, the genetically modified host cell is a prokaryotic cell.

In certain embodiments of any of the foregoing or following, at least one of the one or more heterologous nucleic acids is integrated into the chromosome of the genetically modified host cell.

In certain embodiments of any of the foregoing or following, at least one of the one or more heterologous nucleic acids is maintained extrachromosomally.

In certain embodiments of any of the foregoing or following, two or more of the one or more heterologous nucleic acids are present in a single expression vector.

In certain embodiments of any of the foregoing or following, at least one of the heterologous nucleic acids is operably linked to an inducible promoter.

In certain embodiments of any of the foregoing or following, at least one of the heterologous nucleic acids is operably linked to a constitutive promoter.

In certain embodiments of any of the foregoing or following, culturing of the genetically modified host cell in a suitable medium provides for synthesis of the cannabinoid or the cannabinoid derivative in an increased amount compared to a non-genetically modified host cell cultured under similar conditions.

In certain embodiments of any of the foregoing or following, the genetically modified host cell further comprises one or more heterologous nucleic acids encoding a cannabinoid synthase polypeptide. In some embodiments, the cannabinoid synthase polypeptide is a tetrahydrocannabinolic acid (THCA) synthase polypeptide. In some embodiments, the THCA synthase polypeptide comprises an amino acid sequence having at least 50% sequence identity to SEQ ID NO:14, SEQ ID NO:86, SEQ ID NO:104, SEQ ID NO:153, or SEQ ID NO:155. In some embodiments, the cannabinoid synthase polypeptide is a cannabidiolic acid (CBDA) synthase polypeptide. In some embodiments, the CBDA synthase polypeptide comprises an amino acid sequence having at least 50% sequence identity to SEQ ID NO:88 or SEQ ID NO:151.

In certain embodiments of any of the foregoing or following, the cannabinoid is cannabigerolic acid, cannabigerol, $\Delta^9$-tetrahydrocannabinolic acid, $\Delta^9$-tetrahydrocannabinol, $\Delta^8$-tetrahydrocannabinolic acid, $\Delta^8$-tetrahydrocannabinol, cannabidiolic acid, cannabidiol, cannabichromenic acid, cannabichromene, cannabinolic acid, cannabinol, cannabidivarinic acid, cannabidivarin, tetrahydrocannabivarinic acid, tetrahydrocannabivarin, cannabichromevarinic acid, cannabichromevarin, cannabigerovarinic acid, cannabigerovarin, cannabicyclolic acid, cannabicyclol, cannabielsoinic acid, cannabielsoin, cannabicitranic acid, or cannabicitran.

One aspect of the disclosure relates to a method of producing a cannabinoid or a cannabinoid derivative in a genetically modified host cell, the method comprising: a) culturing the genetically modified host cell in a suitable medium; and b) recovering the produced cannabinoid or cannabinoid derivative.

Another aspect of the disclosure relates to a method of producing a cannabinoid or a cannabinoid derivative in a genetically modified host cell, the method comprising: a) culturing the genetically modified host cell in a suitable medium comprising a carboxylic acid; b) recovering the produced cannabinoid or cannabinoid derivative.

One aspect of the disclosure relates to a method of producing a cannabinoid or a cannabinoid derivative in a genetically modified host cell, the method comprising: a) culturing the genetically modified host cell in a suitable medium comprising olivetolic acid or an olivetolic acid derivative; b) recovering the produced cannabinoid or cannabinoid derivative.

Another aspect of the disclosure relates to a method of producing a cannabinoid or a cannabinoid derivative in a genetically modified host cell, the method comprising: a) culturing a genetically modified host cell comprising one or more heterologous nucleic acids encoding a GOT polypeptide, wherein said GOT polypeptide catalyzes production of cannabigerolic acid from GPP and olivetolic acid in an amount at least ten times higher than a polypeptide comprising an amino acid sequence set forth in SEQ ID NO:82, in a suitable medium; and b) recovering the produced cannabinoid or cannabinoid derivative.

One aspect of the disclosure relates to a method of producing a cannabinoid or a cannabinoid derivative in a genetically modified host cell, the method comprising: a) culturing a genetically modified host cell comprising one or more heterologous nucleic acids encoding a GOT polypeptide comprising an amino acid sequence having at least 65% sequence identity to SEQ ID NO:110 in a suitable medium; and b) recovering the produced cannabinoid or cannabinoid derivative.

Another aspect of the disclosure relates to a method of producing a cannabinoid or a cannabinoid derivative in a genetically modified host cell, the method comprising: a) culturing a genetically modified host cell comprising one or more heterologous nucleic acids encoding a GOT polypeptide comprising an amino acid sequence having at least 65% sequence identity to SEQ ID NO:100 in a suitable medium; and b) recovering the produced cannabinoid or cannabinoid derivative.

In certain embodiments of any of the foregoing or following, the suitable medium comprises a fermentable sugar. In some embodiments, the suitable medium comprises a pretreated cellulosic feedstock.

In certain embodiments of any of the foregoing or following, the suitable medium comprises a non-fermentable carbon source. In some embodiments, the non-fermentable carbon source comprises ethanol.

One aspect of the disclosure relates to an isolated or purified GOT polypeptide, wherein said GOT polypeptide catalyzes production of cannabigerolic acid from GPP and olivetolic acid in an amount at least ten times higher than a polypeptide comprising an amino acid sequence set forth in SEQ ID NO:82.

Another aspect of the disclosure relates to an isolated or purified polypeptide comprising an amino acid sequence having at least 65% sequence identity to SEQ ID NO:110.

One aspect of the disclosure relates to an isolated or purified polypeptide comprising an amino acid sequence having at least 65% sequence identity to SEQ ID NO:100.

Another aspect of the disclosure relates to an isolated or purified nucleic acid encoding a GOT polypeptide, wherein said GOT polypeptide catalyzes production of cannabigerolic acid from GPP and olivetolic acid in an amount at least ten times higher than a polypeptide comprising an amino acid sequence set forth in SEQ ID NO:82.

One aspect of the disclosure relates to an isolated or purified nucleic acid encoding a polypeptide comprising an amino acid sequence having at least 65% sequence identity to SEQ ID NO:110.

Another aspect of the disclosure relates to an isolated or purified nucleic acid encoding a polypeptide comprising an amino acid sequence having at least 65% sequence identity to SEQ ID NO:100.

One aspect of the disclosure relates to a vector comprising a nucleic acid encoding a GOT polypeptide, wherein said GOT polypeptide catalyzes production of cannabigerolic acid from GPP and olivetolic acid in an amount at least ten times higher than a polypeptide comprising an amino acid sequence set forth in SEQ ID NO:82.

Another aspect of the disclosure relates to a vector comprising a nucleic acid encoding a polypeptide comprising an amino acid sequence having at least 65% sequence identity to SEQ ID NO:110.

One aspect of the disclosure relates to a vector comprising a nucleic acid encoding a polypeptide comprising an amino acid sequence having at least 65% sequence identity to SEQ ID NO:100.

Another aspect of the disclosure relates to a method of making a genetically modified host cell for producing a cannabinoid or a cannabinoid derivative, comprising introducing one or more heterologous nucleic acids encoding a GOT polypeptide, wherein said GOT polypeptide catalyzes production of cannabigerolic acid from GPP and olivetolic acid in an amount at least ten times higher than a polypeptide comprising an amino acid sequence set forth in SEQ ID NO:82, into the genetically modified host cell.

One aspect of the disclosure relates to a method of making a genetically modified host cell for producing a cannabinoid or a cannabinoid derivative, comprising introducing one or more heterologous nucleic acids encoding a GOT polypeptide comprising an amino acid sequence having at least 65% sequence identity to SEQ ID NO:110 into the genetically modified host cell.

Another aspect of the disclosure relates to a method of making a genetically modified host cell for producing a cannabinoid or a cannabinoid derivative, comprising introducing one or more heterologous nucleic acids encoding a GOT polypeptide comprising an amino acid sequence having at least 65% sequence identity to SEQ ID NO:100 into the genetically modified host cell.

One aspect of the disclosure relates to a method of making a genetically modified host cell for producing a cannabinoid or a cannabinoid derivative, comprising introducing a vector comprising a nucleic acid encoding a GOT polypeptide, wherein said GOT polypeptide catalyzes production of cannabigerolic acid from GPP and olivetolic acid in an amount at least ten times higher than a polypeptide comprising an amino acid sequence set forth in SEQ ID NO:82; a vector comprising a nucleic acid encoding a polypeptide comprising an amino acid sequence having at least 65% sequence identity to SEQ ID NO:110; or a vector comprising a nucleic acid encoding a polypeptide comprising an amino acid sequence having at least 65% sequence identity to SEQ ID NO:100, into the genetically modified host cell.

BRIEF DESCRIPTION OF THE DRAWINGS

FIG. 12 also depicts production of olivetolic acid or cannabinoid derivatives from these carboxylic acids.

FIG. 28 depicts the production of CBDA with a CBDA synthase polypeptide with an N-terminal truncation and a ProA signal sequence. The figure illustrates an LC-MS trace (m/z=357.2144) for ethyl acetate extraction of yXL047 colony 1 (Duplicate 1), a yXL047 colony 2 (Duplicate 2), a negative control (Negative) and a standard containing CBDA and THCA (Standard). The peak at 7.9 mins indicated the presence of CBDA and the peak at 9.6 mins indicated the presence of THCA.

DETAILED DESCRIPTION

Figure 1:
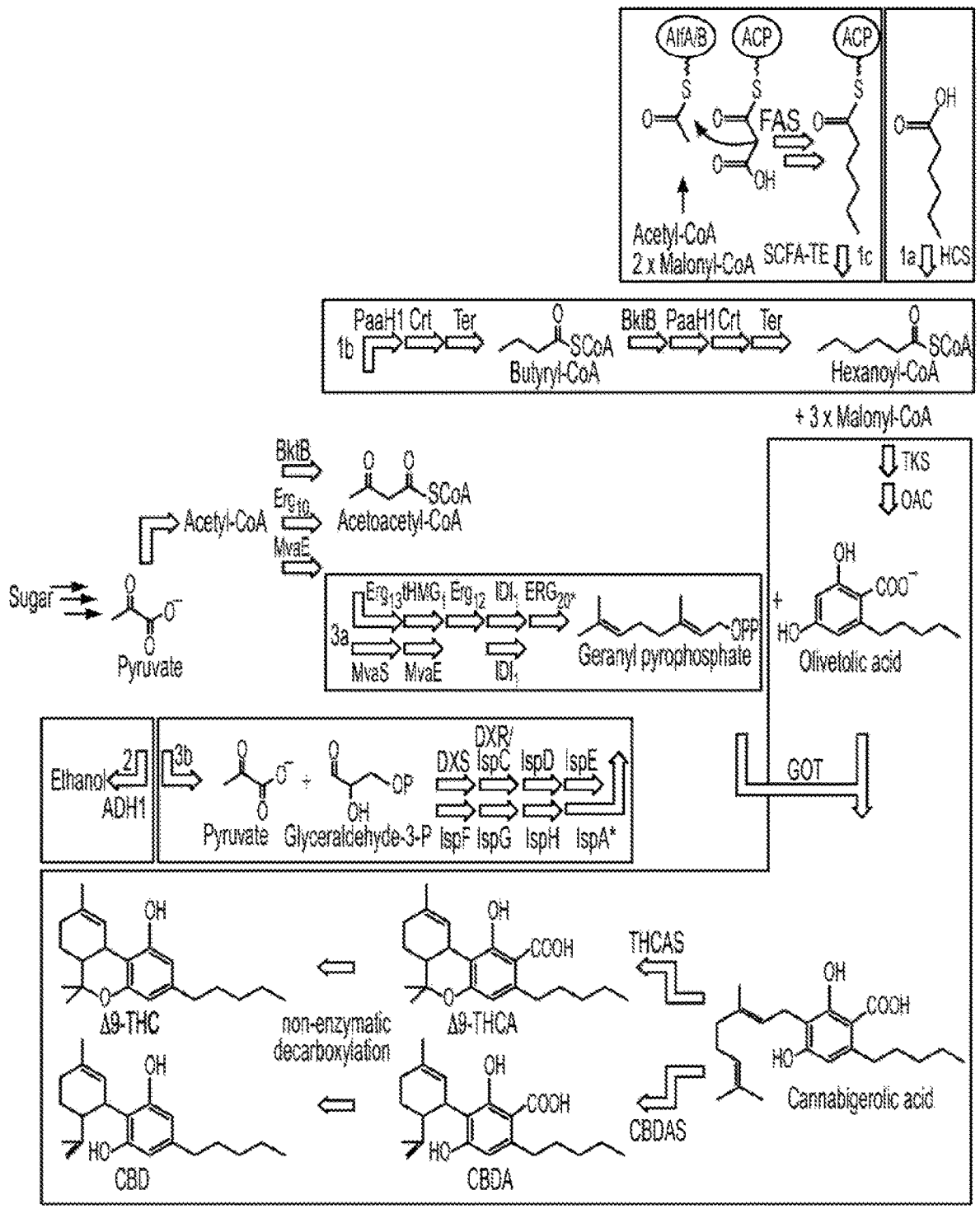
FIG. 1 provides a schematic diagram of biosynthetic pathways for generating cannabinoids, cannabinoid derivatives, cannabinoid precursors, or cannabinoid precursor derivatives.

The present disclosure provides methods, polypeptides, nucleic acids encoding said polypeptides, and genetically modified host cells for producing cannabinoids, cannabinoid precursors, cannabinoid derivatives (e.g., non-naturally occurring cannabinoids), or cannabinoid precursor derivatives (e.g., non-naturally occurring cannabinoid precursors).

Geranyl pyrophosphate olivetolic acid geranyltransferase (GOT, Enzyme Commission Number 2.5.1.102) polypeptides play an important role in the biosynthesis of cannabinoids, but reconstituting their activity in a genetically modified host cell has proven challenging, hampering progress in the production of cannabinoids or cannabinoid derivatives. Herein, novel genes encoding polypeptides of the disclosure that catalyze production of cannabigerolic acid (CBGA) from GPP and olivetolic acid have been identified, isolated, and characterized. Surprisingly, these polypeptides of the present disclosure can catalyze production of CBGA from GPP and olivetolic acid in an amount at least ten times higher than previously discovered *Cannabis* polypeptides that catalyze production of CBGA from GPP and olivetolic acid (see, for example, U.S. Patent Application Pub. No. US20120144523 and the GOT polypeptide, CsPT1, disclosed therein; SEQ ID NO:82 herein). The new polypeptides of the present disclosure that catalyze production of CBGA from GPP and olivetolic acid are GOT polypeptides (e.g., the CsPT4 polypeptide) and can generate cannabinoids and cannabinoid derivatives in vivo (e.g., within a genetically modified host cell) and in vitro (e.g., cell-free). These new GOT polypeptides, as well as nucleic acids encoding said GOT polypeptides, are useful in the methods and genetically modified host cells of the disclosure for producing cannabinoids or cannabinoid derivatives.

The methods of the disclosure may include using microorganisms genetically engineered (e.g., genetically modified host cells) to produce naturally-occurring and non-naturally occurring cannabinoids or cannabinoid precursors. Naturally-occurring cannabinoids and cannabinoid precursors and non-naturally occurring cannabinoids and cannabinoid precursors (e.g., cannabinoid derivatives and cannabinoid precursor derivatives) are challenging to synthesize using chemical synthesis due to their complex structures. The methods of the disclosure enable the construction of metabolic pathways inside living cells to produce bespoke cannabinoids, cannabinoid precursors, cannabinoid derivatives, or cannabinoid precursor derivatives from simple precursors such as sugars and carboxylic acids. One or more heterologous nucleic acids disclosed herein encoding one or more polypeptides disclosed herein can be introduced into host microorganisms allowing for the stepwise conversion of inexpensive feedstocks, e.g., sugar, into final products: cannabinoids, cannabinoid precursors, cannabinoid derivatives, or cannabinoid precursor derivatives. These products can be specified by the choice and construction of expression constructs or vectors comprising one or more heterologous nucleic acids disclosed herein, allowing for the efficient bioproduction of chosen cannabinoid precursors; cannabinoids, such as THC or CBD and less common cannabinoid species found at low levels in *Cannabis*; or cannabinoid derivatives or cannabinoid precursor derivatives. Bioproduction also enables synthesis of cannabinoids, cannabinoid derivatives, cannabinoid precursors, or cannabinoid precursor derivatives with defined stereochemistries, which is challenging to do using chemical synthesis.

Figure 11:
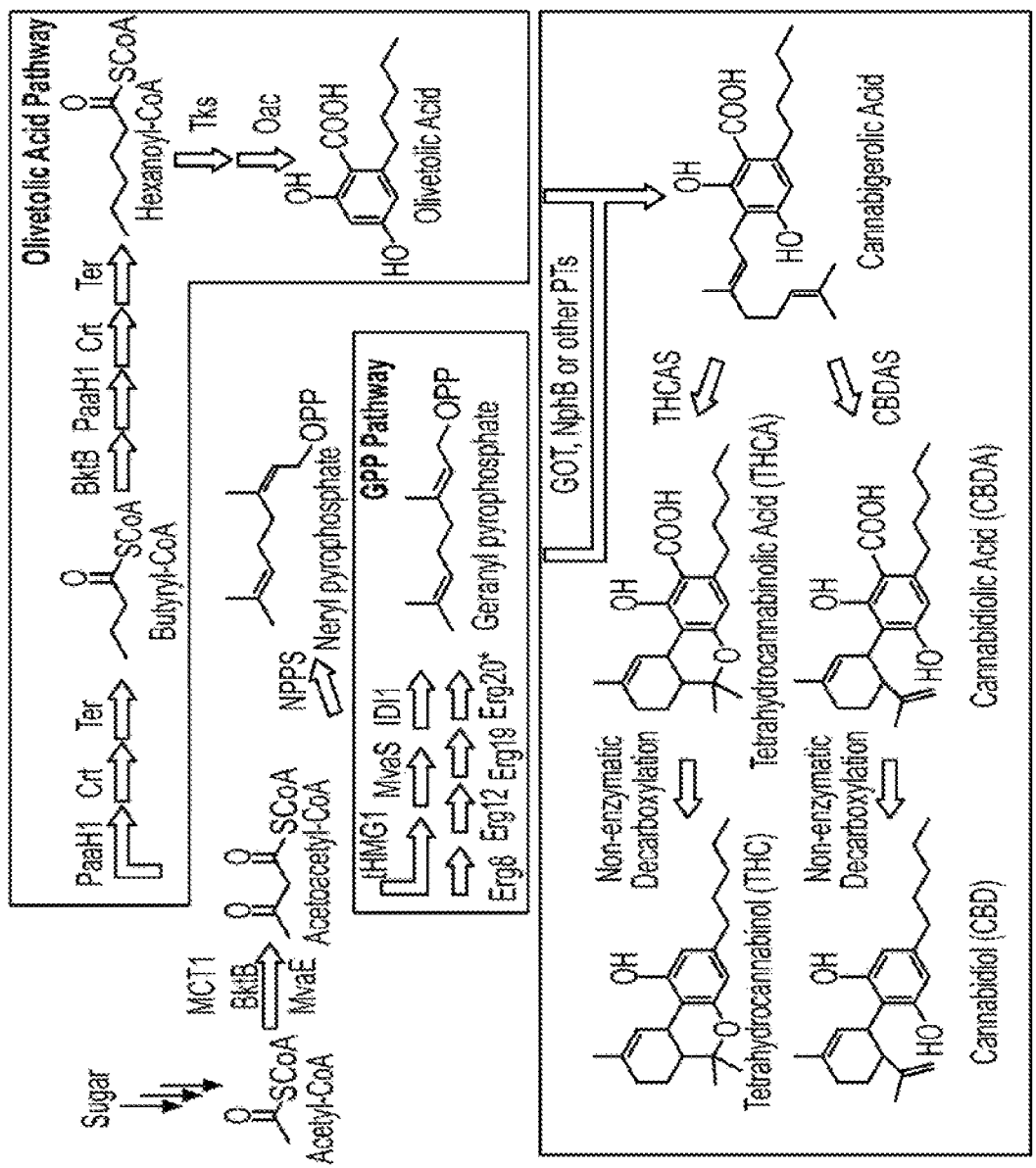
FIG. 11 is a schematic depiction of pathways for production of olivetolic acid derivatives by feeding various representative carboxylic acids, where the carboxylic acids are converted to their CoA forms by a promiscuous acyl-activating enzyme polypeptide (e.g., CsAAE1; CsAAE3), generating olivetolic acid derivatives.
Figure 11:
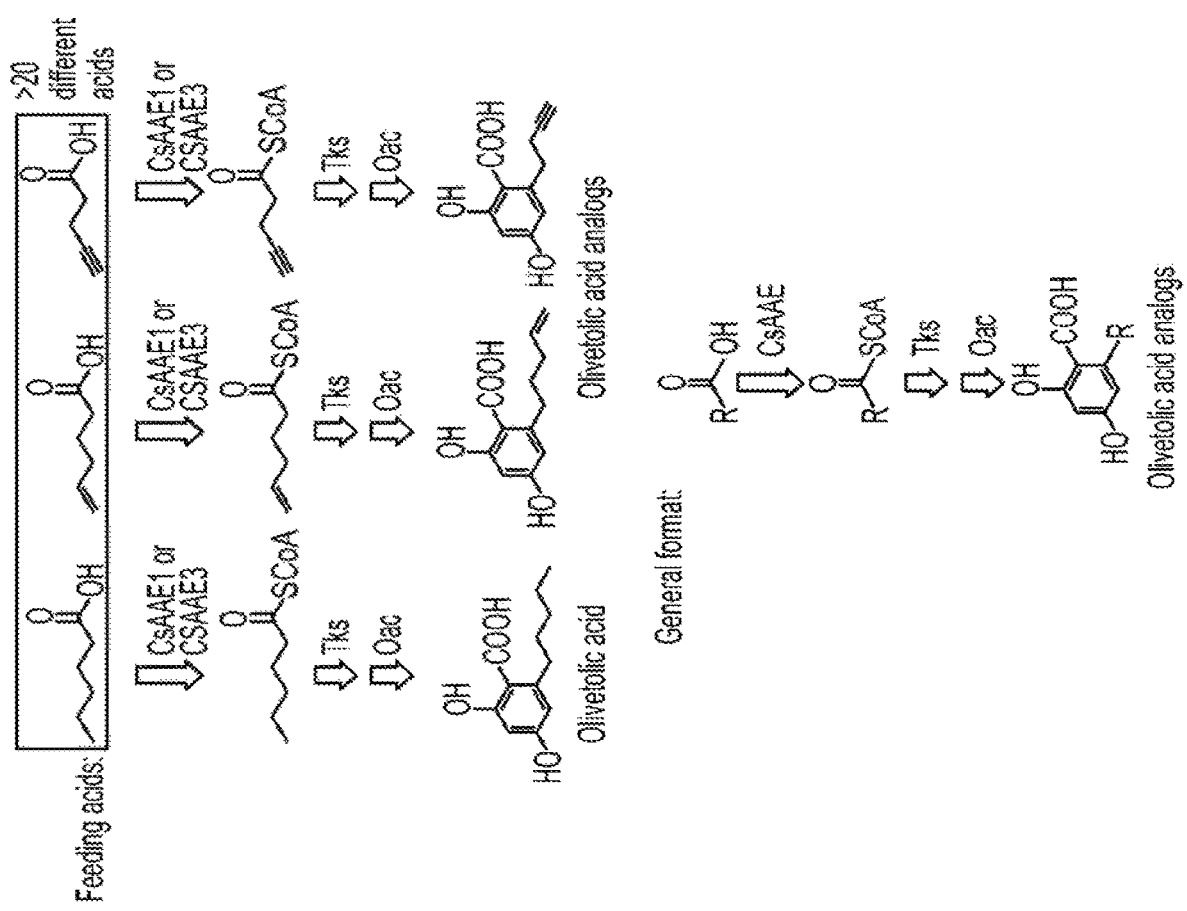

The nucleic acids disclosed herein may include those encoding a polypeptide having at least one activity of a polypeptide present in the cannabinoid biosynthetic pathway, such as a GOT polypeptide (e.g., a CsPT4 polypeptide), responsible for the biosynthesis of the cannabinoid CBGA; a tetraketide synthase (TKS) polypeptide; an olivetolic acid cyclase (OAC) polypeptide; and a CBDA or THCA synthase polypeptide (see FIGS. 1 and 11). Nucleic acids disclosed herein may also include those encoding a polypeptide having at least one activity of a polypeptide involved in the synthesis of cannabinoid precursors. These polypeptides include, but are not limited to, polypeptides having at least one activity of a polypeptide present in the mevalonate pathway; polypeptides that generate acyl-CoA compounds or acyl-CoA compound derivatives (e.g., an acyl-activating enzyme polypeptide, a fatty acyl-CoA synthetase polypeptide, or a fatty acyl-CoA ligase polypeptide); polypeptides that generate GPP; polypeptides that generate malonyl-CoA; polypeptides that condense two molecules of acetyl-CoA to generate acetoacetyl-CoA, or pyruvate decarboxylase polypeptides (see FIGS. 1 and 11).

The disclosure also provides for generation of cannabinoid precursor derivatives or cannabinoid derivatives, as well as cannabinoids or precursors thereof, with polypeptides that generate acyl-CoA compounds or acyl-CoA compound derivatives. In certain such embodiments, genetically modified host cells disclosed herein are modified with one or more heterologous nucleic acids encoding a polypeptide that generates acyl-CoA compounds or acyl-CoA compound derivatives. These polypeptides may permit production of hexanoyl-CoA, acyl-CoA compounds, derivatives of hexanoyl-CoA, or derivatives of acyl-CoA compounds. In some embodiments, hexanoic acid or carboxylic acids other than hexanoic acid are fed to genetically modified host cells expressing a polypeptide that generates acyl-CoA compounds or acyl-CoA compound derivatives (e.g., are present in the culture medium in which the cells are grown) to generate hexanoyl-CoA, acyl-CoA compounds, derivatives of hexanoyl-CoA, or derivatives of acyl-CoA compounds. These compounds are then converted to cannabinoid derivatives or cannabinoid precursor derivatives, as well as cannabinoids or precursors thereof, via one or more polypeptides having at least one activity of a polypeptide present in the cannabinoid biosynthetic pathway or involved in the synthesis of cannabinoid precursors (see FIGS. 1 and 11).

Surprisingly, it was found that polypeptides that generate acyl-CoA compounds or acyl-CoA compound derivatives, as well as many polypeptides having at least one activity of a polypeptide present in the cannabinoid biosynthetic pathway, such as TKS polypeptides, OAC polypeptides, GOT polypeptides (e.g., a CsPT4 polypeptide), and CBDA or THCA synthase polypeptides, have broad substrate specificity. This broad substrate specificity permits generation of not only cannabinoids and cannabinoid precursors, but also cannabinoid derivatives and cannabinoid precursor derivatives that are not naturally occurring, both within a genetically modified host cell or in a cell-free reaction mixture comprising one or more of the polypeptides disclosed herein. Because of this broad substrate specificity, hexanoyl-CoA, acyl-CoA compounds, derivatives of hexanoyl-CoA, or derivatives of acyl-CoA compounds produced in genetically modified host cells by polypeptides that generate acyl-CoA compounds or acyl-CoA compound derivatives can be utilized by TKS and OAC polypeptides to make olivetolic acid or derivatives thereof. The olivetolic acid or derivatives thereof can then be utilized by a GOT polypeptide to afford cannabinoids or cannabinoid derivatives. Alternatively, olivetolic acid or derivatives thereof can be fed to genetically modified host cells comprising a GOT polypeptide to afford cannabinoids or cannabinoid derivatives. These cannabinoids or cannabinoid derivatives can then be converted to THCA or CDBA, or derivatives thereof, via a CBDA or THCA synthase polypeptide.

Besides allowing for the production of desired cannabinoids, cannabinoid derivatives, cannabinoid precursors, or cannabinoid precursor derivatives, the present disclosure provides a more reliable and economical process than agriculture-based production. Microbial fermentations can be completed in days versus the months necessary for an agricultural crop, are not affected by climate variation or soil contamination (e.g., by heavy metals), and can produce pure products at high titer.

The present disclosure also provides a platform for the economical production of cannabinoid precursors, or derivatives thereof, and high-value cannabinoids including THC and CBD, as well as derivatives thereof. It also provides for the production of different cannabinoids, cannabinoid derivatives, cannabinoid precursors, or cannabinoid precursor derivatives for which no viable method of production exists.

Additionally, the disclosure provides methods, genetically modified host cells, polypeptides, and nucleic acids encoding said polypeptides to produce cannabinoids, cannabinoid derivatives, cannabinoid precursors, or cannabinoid precursor derivatives in vivo or in vitro from simple precursors. Nucleic acids disclosed herein encoding one or more polypeptides disclosed herein can be introduced into microorganisms (e.g., genetically modified host cells), resulting in expression or overexpression of the one or more polypeptides, which can then be utilized in vitro or in viva for the production of cannabinoids, cannabinoid derivatives, cannabinoid precursors, or cannabinoid precursor derivatives. In some embodiments, the in vitro methods are cell-free.

To produce cannabinoids, cannabinoid derivatives, cannabinoid precursors, or cannabinoid precursor derivatives, and create biosynthetic pathways within genetically modified host cells, the genetically modified host cells may express or overexpress combinations of the heterologous nucleic acids disclosed herein encoding polypeptides disclosed herein.

Cannabinoid Biosynthesis

Nucleic acids encoding polypeptides having at least one activity of a polypeptide present in the cannabinoid biosynthesis pathway can be useful in the methods and genetically modified host cells disclosed herein for the synthesis of cannabinoids, cannabinoid precursors, cannabinoid derivatives, or cannabinoid precursor derivatives.

In *Cannabis*, cannabinoids are produced from the common metabolite precursors geranylpyrophosphate (GPP) and hexanoyl-CoA by the action of three polypeptides so far only identified in *Cannabis*. Hexanoyl-CoA and malonyl-CoA are combined to afford a 12-carbon tetraketide intermediate by a TKS polypeptide. This tetraketide intermediate is then cyclized by an OAC polypeptide to produce olivetolic acid. Olivetolic acid is then prenylated with the common isoprenoid precursor GPP by a GOT polypeptide (e.g., a. CsPT4 polypeptide) to produce CBGA, the cannabinoid also known as the "mother cannabinoid." Different synthase polypeptides then convert CBGA into other cannabinoids, e.g., a THCA synthase polypeptide produces THCA, a CBDA synthase polypeptide produces CBDA, etc. In the presence of heat or light, the acidic cannabinoids can undergo decarboxylation, e.g., THCA producing THC or CBDA producing CBD.

GPP and hexanoyl-CoA can be generated through several pathways (see FIGS. 1 and 11). One or more nucleic acids encoding one or more polypeptides having at least one activity of a polypeptide present in these pathways can be useful in the methods and genetically modified host cells for the synthesis of cannabinoids, cannabinoid precursors, cannabinoid derivatives, or cannabinoid precursor derivatives.

Polypeptides that generate GPP or are part of a biosynthetic pathway that generates GPP may be one or more polypeptides having at least one activity of a polypeptide present in the mevalonate (MEV) pathway. The term "mevalonate pathway" or "MEV pathway," as used herein, may refer to the biosynthetic pathway that converts acetyl-CoA to isopentenyl pyrophosphate (IPP) and dimethylallyl pyrophosphate (DMAPP). The mevalonate pathway comprises polypeptides that catalyze the following steps: (a) condensing two molecules of acetyl-CoA to generate acetoacetyl-CoA (e.g., by action of an acetoacetyl-CoA thiolase polypeptide); (b) condensing acetoacetyl-CoA with acetyl-CoA to form hydroxymethylglutaryl-CoA (HMG-CoA) (e.g., by action of a HMG-CoA synthase (HMGS) polypeptide); (c) converting HMG-CoA to mevalonate (e.g., by action of a CoA reductase (HMGR) polypeptide); (d) phosphorylating mevalonate to mevalonate 5-phosphate (e.g., by action of a mevalonate kinase (MK) polypeptide); (e) converting mevalonate 5-phosphate to mevalonate 5-pyrophosphate (e.g., by action of a phosphomevalonate kinase (PMK) polypeptide); (f) converting mevalonate 5-pyrophosphate to isopentenyl pyrophosphate (e.g., by action of a mevalonate pyrophosphate decarboxylase (MVD) polypeptide); and (g) converting isopentenyl pyrophosphate (IPP) to dimethylallyl pyrophosphate (DMAPP) (e.g., by action of an isopentenyl pyrophosphate isomerase (IDI) polypeptide) (FIGS. 1 and 11). A geranyl diphosphate synthase (GPPS) polypeptide then acts on IPP and/or DMAPP to generate GPP. Additionally, polypeptides that generate GPP or are part of a biosynthetic pathway that generates GPP may be one or more polypeptides having at least one activity of a polypeptide present in the deoxyxylulose-5-phosphate (DXP) pathway, instead of those of the MEV pathway (FIG. 1).

Polypeptides that generate hexanoyl-CoA may include polypeptides that generate acyl-CoA compounds or acyl-CoA compound derivatives (e.g., a hexanoyl-CoA synthase (HCS) polypeptide, an acyl-activating enzyme polypeptide, a fatty acyl-CoA synthetase polypeptide, or a fatty acyl-CoA ligase polypeptide). Hexanoyl-CoA may also be generated through pathways comprising one or more polypeptides that generate malonyl-CoA, such as an acetyl-CoA carboxylase (ACC) polypeptide. Additionally, hexanoyl-CoA may be generated with one or more polypeptides that are part of a biosynthetic pathway that produces hexanoyl-CoA, including, but not limited to: a malonyl CoA-acyl carrier protein transacylase (MCT1) polypeptide, a PaaH1 polypeptide, a Crt polypeptide, a Ter polypeptide, and a BktB polypeptide; a MCT1 polypeptide, a PhaB polypeptide, a PhaJ polypeptide, a Ter polypeptide, and a BktB polypeptide; a short chain fatty acyl-CoA thioesterase (SCFA-TE) polypeptide; or a fatty acid synthase (FAS) polypeptide (see FIGS. 1 and 11). Hexanoyl CoA derivatives, acyl-CoA compounds, or acyl-CoA compound derivatives may also be formed via such pathways and polypeptides.

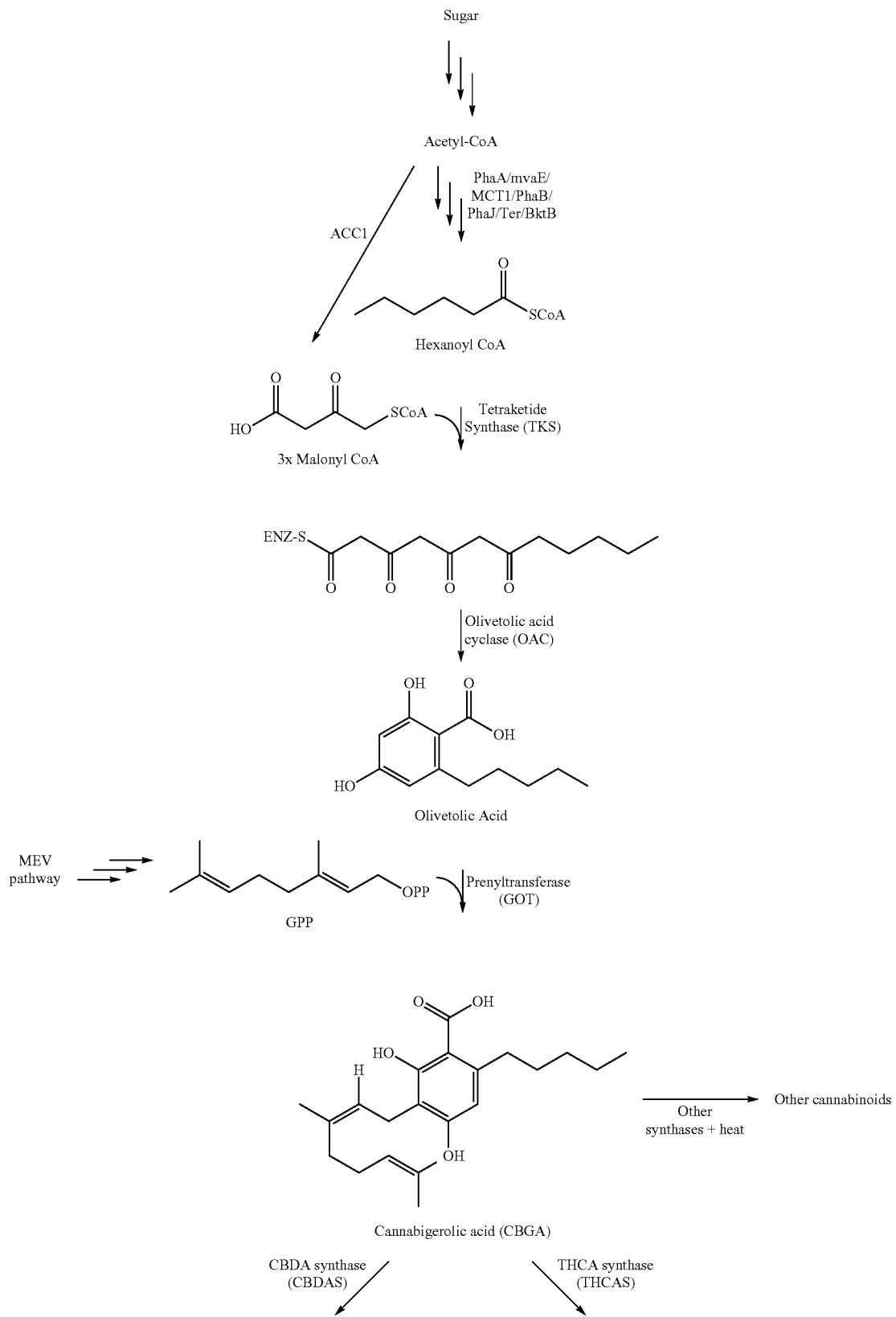

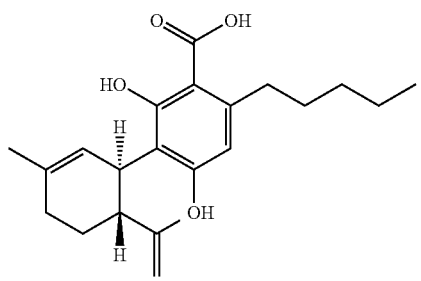

Cannabidiolic acid / CBDA

↓ Heat

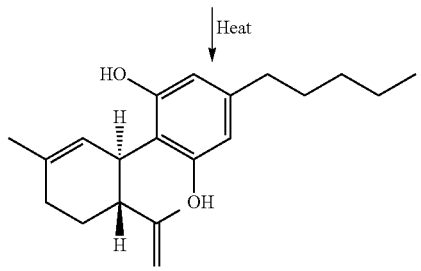

Cannabidiol / CBD

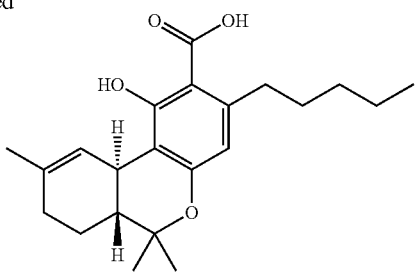

Tetrahydrocannabinolic acid / THCA

↓ Heat

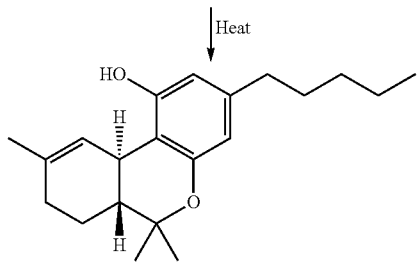

Tetrahydrocannabinol / Dronabinol / Marinol / THC

Biosynthetic Pathways to Cannabinoids

GPP and hexanoyl-CoA may also be generated through pathways comprising polypeptides that condense two molecules of acetyl-CoA to generate acetoacetyl-CoA and pyruvate decarboxylase polypeptides that generate acetyl-CoA from pyruvate (see FIGS. 1 and 11). Hexanoyl CoA derivatives, acyl-CoA compounds, or acyl-CoA compound derivatives may also be formed via such pathways.

General Information

The practice of the present disclosure will employ, unless otherwise indicated, conventional techniques of molecular biology (including recombinant techniques), microbiology, cell biology, biochemistry, and immunology, which are within the skill of the art. Such techniques are explained fully in the literature: "*Molecular Cloning: A Laboratory Manual*," second edition (Sambrook et al., 1989); "*Oligonucleotide Synthesis*" (M. J. Gait, ed., 1984); "*Animal Cell Culture*" (R. I. Freshney, ed., 1987); "*Methods in Enzymology*" (Academic Press, Inc.); "*Current Protocols in Molecular Biology*" (F. M. Ausubel et al., eds., 1987, and periodic updates); "*PCR: The Polymerase Chain Reaction*," (Mullis et al., eds., 1994). Singleton et al., *Dictionary of Microbiology and Molecular Biology* 2nd ed., J. Wiley & Sons (New York, N.Y. 1994), and March, *Advanced Organic Chemistry Reactions, Mechanisms and Structure* 4th ed., John Wiley & Sons (New York, N.Y. 1992), provide one skilled in the art with a general guide to many of the terms used in the present application.

"Cannabinoid" or "cannabinoid compound" as used herein may refer to a member of a class of unique meroterpenoids found until now only in *Cannabis sativa*. Cannabinoids may include, but are not limited to, cannabichromene (CBC) type (e.g. cannabichromenic acid), cannabigerol (CBG) type (e.g. cannabigerolic acid), cannabidiol (CBD) type (e.g. cannabidiolic acid), $\Delta^9$-trans-tetrahydrocannabinol ($\Delta^9$-THC) type (e.g. $\Delta^9$-tetrahydrocannabinolic acid), $\Delta^8$-trans-tetrahydrocannabinol ($\Delta^8$-THC) type, cannabicyclol (CBL) type, cannabielsoin (CBE) type, cannabinol (CBN) type, cannabinodiol (CBND) type, cannabitriol (CBT) type, cannabigerolic acid (CBGA), cannabigerolic acid monomethylether (CBGAM), cannabigerol (CBG), cannabigerol monomethylether (CBGM), cannabigerovarinic acid (CBGVA), cannabigerovarin (CBGV), cannabichromenic acid (CBCA), cannabichromene (CBC), cannabichromevarinic acid (CBCVA), cannabichromevarin (CBCV), cannabidiolic acid (CBDA), cannabidiol (CBD), cannabidiol monomethylether (CBDM), cannabidiol-$C_4$ (CBD-$C_4$), cannabidivarinic acid (CBDVA), cannabidivarin (CBDV), cannabidiorcol (CBD-$C_1$), $\Delta^9$-tetrahydrocannabinolic acid A (THCA-A), $\Delta^9$-tetrahydrocannabinolic acid B (THCA-B), $\Delta^9$-tetrahydrocannabinol (THC), $\Delta^9$-tetrahydrocannabinolic acid-$C_4$ (THCA-$C_4$), $\Delta^9$-tetrahydrocannabinol-$C_4$ (THC-$C_4$), $\Delta^9$-tetrahydrocannabivarinic acid (THCVA), $\Delta^9$-tetrahydrocannabivarin (THCV), $\Delta^9$-tetrahydrocannabiorcolic acid (THCA-$C_1$), $\Delta^9$-tetrahydrocannabiorcol (THC-$C_1$), $\Delta^7$-cis-iso-tetrahydrocannabivarin, $\Delta^8$-tetrahydrocannabinolic acid ($\Delta^8$-THCA), $\Delta^8$-tetrahydrocannabinol ($\Delta^8$-THC), cannabicyclolic acid (CBLA), cannabicyclol (CBL), cannabicyclovarin (CBLV), cannabielsoic acid A (CBEA-A), cannabielsoic acid B (CBEA-B), cannabielsoin (CBE), cannabielsoinic acid, cannabicitranic acid, cannabinolic acid (CBNA), cannabinol (CBN), cannabinol methylether (CBNM), cannabinol-$C_4$, (CBN-$C_4$), cannabivarin (CBV), cannabinol-$C_2$ (CNB-$C_2$), cannabiorcol (CBN-$C_1$), cannabinodiol (CBND), cannabinodivarin (CBVD), cannabitriol (CBT), 10-ethyoxy-9-hydroxy-delta-6a-tetrahydrocannabinol, 8,9-dihydroxyl-delta-6a-tetrahydrocannabinol, cannabitriolvarin (CBTVE), dehydrocannabifuran (DCBF), cannabifuran (CBF), cannabichromanon (CBCN), cannabicitran (CBT), 10-oxo-delta-6a-tetrahydrocannabinol (OTHC), delta-9-cis-tetrahydrocannabinol (cis-THC), 3,4,5,6-tetrahydro-7-hydroxy-alpha-alpha-2-trimethyl-9-n-propyl-2,6-methano-2H-1-benzoxocin-5-methanol (OH-iso-HHCV), cannabiripsol (CBR), and trihydroxy-delta-9-tetrahydrocannabinol (triOH-THC).

"Cannabinoid precursor" as used herein may refer to any intermediate present in the cannabinoid biosynthetic pathway before the production of the "mother cannabinoid," cannabigerolic acid (CBGA). Cannabinoid precursors may include, but are not limited to, GPP, olivetolic acid, hexanoyl-CoA, pyruvate, acetoacetyl-CoA, butyryl-CoA, acetyl-CoA, HMG-CoA, mevalonate, mevalonate-5-phosphate, mevalonate diphosphate, and malonyl-CoA.

An acyl-CoA compound as detailed herein may include compounds with the following structure:

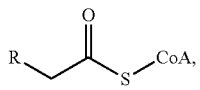

wherein R is a fatty acid side chain optionally comprising one or more functional and/or reactive groups as disclosed herein (i.e., an acyl-CoA compound derivative).

As used herein, a hexanoyl CoA derivative, an acyl-CoA compound derivative, a cannabinoid derivative, or a cannabinoid precursor derivative (e.g., an olivetolic acid derivative) is produced by a genetically modified host cell disclosed herein or in a cell-free reaction mixture comprising one or more of the polypeptides disclosed herein and may refer to hexanoyl CoA, an acyl-CoA compound, a cannabinoid, or a cannabinoid precursor (e.g., olivetolic acid) comprising one or more functional and/or reactive groups. Functional groups may include, but are not limited to, azido, halo (e.g., chloride, bromide, iodide, fluorine), methyl, alkyl (including branched and linear alkyl groups), alkynyl, alkenyl, methoxy, alkoxy, acetyl, amino, carboxyl, carbonyl, oxo, ester, hydroxyl, thio, cyano, aryl, heteroaryl, cycloalkyl, cycloalkenyl, cycloalkylalkenyl, cycloalkylalkynyl, cycloalkenylalkyl, cycloalkenylalkenyl, cycloalkenylalkynyl, heterocyclylalkenyl, heterocyclylalkynyl, heteroarylalkenyl, heteroarylalkynyl, arylalkenyl, arylalkynyl, heterocyclyl, spirocyclyl, heterospirocyclyl, thioalkyl, sulfone, sulfonyl, sulfoxide, amido, alkylamino, dialkylamino, arylamino, alkylarylamino, diarylamino, N-oxide, imide, enamine, imine, oxime, hydrazone, nitrile, aralkyl, cycloalkylalkyl, haloalkyl, heterocyclylalkyl, heteroarylalkyl, nitro, thioxo, and the like. See, e.g., FIGS. 12 and 13. Suitable reactive groups may include, but are not necessarily limited to, azide, carboxyl, carbonyl, amine, (e.g., alkyl amine (e.g., lower alkyl amine), aryl amine), halide, ester (e.g., alkyl ester (e.g., lower alkyl ester, benzyl ester), aryl ester, substituted aryl ester), cyano, thioester, thioether, sulfonyl halide, alcohol, thiol, succinimidyl ester, isothiocyanate, iodoacetamide, maleimide, hydrazine, alkynyl, alkenyl, and the like. A reactive group may facilitate covalent attachment of a molecule of interest. Suitable molecules of interest may include, but are not limited to, a detectable label; imaging agents; a toxin (including cytotoxins); a linker; a peptide; a drug (e.g., small molecule drugs); a member of a specific binding pair; an epitope tag; ligands for binding by a target receptor; tags to aid in purification; molecules that increase solubility; molecules that enhance bioavailability; molecules that increase in vivo half-life; molecules that target to a particular cell type; molecules that target to a particular tissue; molecules that provide for crossing the blood-brain barrier; molecules to facilitate selective attachment to a surface; and the like. Functional and reactive groups may be optionally substituted with one or more additional functional or reactive groups.

A cannabinoid derivative or cannabinoid precursor derivative produced by a genetically modified host cell disclosed herein or in a cell-free reaction mixture comprising one or more of the polypeptides disclosed herein may also refer a naturally-occurring cannabinoid or naturally-occurring cannabinoid precursor lacking one or more chemical moieties. Such chemical moieties may include, but are not limited to, methyl, alkyl, alkenyl, methoxy, alkoxy, acetyl, carboxyl, carbonyl, oxo, ester, hydroxyl, aryl, heteroaryl, cycloalkyl, cycloalkenyl, cycloalkylalkenyl, cycloalkenylalkyl, cycloalkenylalkenyl, heterocyclylalkenyl, heteroarylalkenyl, arylalkenyl, heterocyclyl, aralkyl, cycloalkylalkyl, heterocyclylalkyl, heteroarylalkyl, and the like. In some embodiments, a cannabinoid derivative or cannabinoid precursor derivative lacking one or more chemical moieties found in a naturally-occurring cannabinoid or naturally-occurring cannabinoid precursor, and produced by a genetically modified host cell disclosed herein or in a cell-free reaction mixture comprising one or more of the polypeptides disclosed herein, may also comprise one or more of any of the functional and/or reactive groups described herein. Functional and reactive groups may be optionally substituted with one or more additional functional or reactive groups.

The term "nucleic acid" used herein, may refer to a polymeric form of nucleotides of any length, either ribonucleotides or deoxynucleotides. Thus, this term may include, but is not limited to, single-, double-, or multi-stranded DNA or RNA, genomic DNA, cDNA, genes, synthetic DNA or RNA, DNA-RNA hybrids, or a polymer comprising purine and pyrimidine bases or other naturally-occurring, chemically or biochemically modified, non-naturally-occurring, or derivatized nucleotide bases.

The terms "peptide," "polypeptide," and "protein" may be used interchangeably herein, and may refer to a polymeric form of amino acids of any length, which can include coded and non-coded amino acids, chemically or biochemically modified or derivatized amino acids, full-length polypeptides, fragments of polypeptides, or polypeptides having modified peptide backbones. The polypeptides disclosed herein may be presented as modified or engineered forms, including truncated or fusion forms, retaining the recited activities. The polypeptides disclosed herein may also be variants differing from a specifically recited "reference" polypeptide (e.g., a wild-type polypeptide) by amino acid insertions, deletions, mutations, and/or substitutions, but retains an activity that is substantially similar to the reference polypeptide.

As used herein, the term "heterologous" may refer to what is not normally found in nature. The term "heterologous nucleotide sequence" may refer to a nucleotide sequence not normally found in a given cell in nature. As such, a heterologous nucleotide sequence may be: (a) foreign to its host cell (i.e., is "exogenous" to the cell); (b) naturally found in the host cell (i.e., "endogenous") but present at an unnatural quantity in the cell (i.e., greater or lesser quantity than naturally found in the host cell); or (c) be naturally found in the host cell but positioned outside of its natural locus. The term "heterologous enzyme" or "heterologous polypeptide" may refer to an enzyme or polypeptide that is not normally found in a given cell in nature. The term encompasses an enzyme or polypeptide that is: (a) exogenous to a given cell (i.e., encoded by a nucleic acid that is not naturally present in the host cell or not naturally present in a given context in the host cell); and (b) naturally found in the host cell (e.g., the enzyme or polypeptide is encoded by a nucleic acid that is endogenous to the cell) but that is produced in an unnatural amount (e.g., greater or lesser than that naturally found) in the host cell. As such, a heterologous nucleic acid may be: (a) foreign to its host cell (i.e., is "exogenous" to the cell); (b) naturally found in the host cell (i.e., "endogenous") but present at an unnatural quantity in the cell (i.e., greater or lesser quantity than naturally found in the host cell); or (c) be naturally found in the host cell but positioned outside of its natural locus.

"Operably linked" may refer to an arrangement of elements wherein the components so described are configured so as to perform their usual function. Thus, control sequences operably linked to a coding sequence are capable of effecting the expression of the coding sequence. The control sequences need not be contiguous with the coding sequence, so long as they function to direct the expression thereof. Thus, for example, intervening untranslated yet transcribed sequences can be present between a promoter sequence and the coding sequence and the promoter sequence can still be considered "operably linked" to the coding sequence.

"Isolated" may refer to polypeptides or nucleic acids that are substantially or essentially free from components that normally accompany them in their natural state. An isolated polypeptide or nucleic acid may be other than in the form or setting in which it is found in nature. Isolated polypeptides and nucleic acids therefore may be distinguished from the polypeptides and nucleic acids as they exist in natural cells. An isolated nucleic acid or polypeptide may further be purified from one or more other components in a mixture with the isolated nucleic acid or polypeptide, if such components are present.

A "genetically modified host cell" (also referred to as a "recombinant host cell") is a host cell into which has been introduced a heterologous nucleic acid, e.g., an expression vector or construct. For example, a prokaryotic host cell is a genetically modified prokaryotic host cell (e.g., a bacterium), by virtue of introduction into a suitable prokaryotic host cell of a heterologous nucleic acid, e.g., an exogenous nucleic acid that is foreign to (not normally found in nature in) the prokaryotic host cell, or a recombinant nucleic acid that is not normally found in the prokaryotic host cell; and a eukaryotic host cell is a genetically modified eukaryotic host cell, by virtue of introduction into a suitable eukaryotic host cell of a heterologous nucleic acid, e.g., an exogenous nucleic acid that is foreign to the eukaryotic host cell, or a recombinant nucleic acid that is not normally found in the eukaryotic host cell.

As used herein, a "cell-free system" may refer to a cell lysate, cell extract or other preparation in which substantially all of the cells in the preparation have been disrupted or otherwise processed so that all or selected cellular components, e.g., organelles, proteins, nucleic acids, the cell membrane itself (or fragments or components thereof), or the like, are released from the cell or resuspended into an appropriate medium and/or purified from the cellular milieu. Cell-free systems can include reaction mixtures prepared from purified or isolated polypeptides and suitable reagents and buffers.

In some embodiments, conservative substitutions may be made in the amino acid sequence of a polypeptide without disrupting the three-dimensional structure or function of the polypeptide. Conservative substitutions may be accomplished by the skilled artisan by substituting amino acids with similar hydrophobicity, polarity, and R-chain length for one another. Additionally, by comparing aligned sequences of homologous proteins from different species, conservative substitutions may be identified by locating amino acid residues that have been mutated between species without altering the basic functions of the encoded proteins. The term "conservative amino acid substitution" may refer to the interchangeability in proteins of amino acid residues having similar side chains. For example, a group of amino acids having aliphatic side chains consists of glycine, alanine, valine, leucine, and isoleucine; a group of amino acids having aliphatic-hydroxyl side chains consists of serine and threonine; a group of amino acids having amide containing side chains consisting of asparagine and glutamine; a group of amino acids having aromatic side chains consists of phenylalanine, tyrosine, and tryptophan; a group of amino acids having basic side chains consists of lysine, arginine, and histidine; a group of amino acids having acidic side chains consists of glutamate and aspartate; and a group of amino acids having sulfur containing side chains consists of cysteine and methionine. Exemplary conservative amino acid substitution groups are: valine-leucine-isoleucine, phenylalanine-tyrosine, lysine-arginine, alanine-valine, and asparagine-glutamine.

A polynucleotide or polypeptide has a certain percent "sequence identity" to another polynucleotide or polypeptide, meaning that, when aligned, that percentage of bases or amino acids are the same, and in the same relative position, when comparing the two sequences. Sequence identity can be determined in a number of different manners. To determine sequence identity, sequences can be aligned using various methods and computer programs (e.g., BLAST, T-COFFEE, MUSCLE, MAFFT, etc.), available over the world wide web at sites including ncbi.nlm.nili.gov/BLAST, ebi.ac.uk/Tools/msa/tcoffee/ebi.ac.uk/Tools/msa/muscle/mafft.cbrc.jp/alignment/software/. See, e.g., Altschul et al. (1990), J. Mol. Biol. 215:403-10.

Before the present disclosure is further described, it is to be understood that this disclosure is not limited to particular embodiments described, as such may, of course, vary. It is also to be understood that the terminology used herein is for the purpose of describing particular embodiments only, and is not intended to be limiting, since the scope of the present disclosure will be limited only by the appended claims.

Where a range of values is provided, it is understood that each intervening value, to the tenth of the unit of the lower limit unless the context clearly dictates otherwise, between the upper and lower limit of that range and any other stated or intervening value in that stated range, is encompassed within the disclosure. The upper and lower limits of these smaller ranges may independently be included in the smaller ranges, and are also encompassed within the disclosure, subject to any specifically excluded limit in the stated range. Where the stated range includes one or both of the limits, ranges excluding either or both of those included limits are also included in the disclosure.

Unless defined otherwise, all technical and scientific terms used herein have the same meaning as commonly understood by one of ordinary skill in the art to which this disclosure belongs. Although any methods and materials similar or equivalent to those described herein can also be used in the practice or testing of the present disclosure, the preferred methods and materials are now described. All publications mentioned herein are incorporated herein by reference to disclose and describe the methods and/or materials in connection with which the publications are cited.

It must be noted that as used herein and in the appended claims, the singular forms "a," "an," and "the" may include plural referents unless the context clearly dictates otherwise. Thus, for example, reference to "a cannabinoid compound" or "cannabinoid" may include a plurality of such compounds and reference to "the genetically modified host cell" may include reference to one or more genetically modified host cells and equivalents thereof known to those skilled in the art, and so forth. It is further noted that the claims may be drafted to exclude any optional element. As such, this statement is intended to serve as antecedent basis for use of such exclusive terminology as "solely," "only" and the like in connection with the recitation of claim elements, or use of a "negative" limitation.

It is appreciated that certain features of the disclosure, which are, for clarity, described in the context of separate embodiments, may also be provided in combination in a single embodiment. Conversely, various features of the disclosure, which are, for brevity, described in the context of a single embodiment, may also be provided separately or in any suitable sub-combination. All combinations of the embodiments pertaining to the disclosure are specifically embraced by the present disclosure and are disclosed herein just as if each and every combination was individually and explicitly disclosed. In addition, all sub-combinations of the various embodiments and elements thereof are also specifically embraced by the present disclosure and are disclosed herein just as if each and every such sub-combination was individually and explicitly disclosed herein.

Geranyl Pyrophosphate:Olivetolic Acid Geranyltransferase Polypeptides and Nucleic Acids Encoding Said Polypeptides As described herein, novel polypeptides for catalyzing production of cannabigerolic acid from GPP and olivetolic acid have been identified and characterized. Surprisingly, these new polypeptides of the present disclosure can catalyze production of cannabigerolic acid from GPP and olivetolic acid in an amount at least ten times higher than previously discovered *Cannabis* polypeptides that catalyze production of cannabigerolic acid from GPP and olivetolic acid (see, for example, U.S. Patent Application Pub. No. US20120144523 and the GOT polypeptide, CsPT1, disclosed therein; SEQ ID NO:82 herein). The new polypeptides of the present disclosure that catalyze production of cannabigerolic acid from GPP and olivetolic acid are new geranyl pyrophosphate:olivetolic acid geranyltransferase (GOT) polypeptides, the CsPT4 polypeptide and truncated versions thereof. These new polypeptides of the present disclosure can generate cannabinoids and cannabinoid derivatives in vivo (e.g., within a genetically modified host cell) and in vitro (e.g., cell-free).

These new GOT polypeptides, as well as nucleic acids encoding said GOT polypeptides, are useful in the methods and genetically modified host cells of the disclosure for producing cannabinoids or cannabinoid derivatives. In some embodiments, the GOT polypeptide of the disclosure cannot catalyze production of 5-geranyl olivetolic acid.

The CsPT4 polypeptide is remarkably different in sequence and activity than the previously identified CsPT1 polypeptide, also a GOT polypeptide. The CsPT1 polypeptide has only 57% homology to the CsPT4 polypeptide. Further, unlike the CsPT1 polypeptide, the activity of the CsPT4 polypeptide, or a truncated version thereof, can be readily reconstituted in a genetically modified host cell of the disclosure, permitting the production of cannabinoids or cannabinoid derivatives by the genetically modified host cells. A truncated version of the CsPT4 polypeptide, the CsPT4t polypeptide, lacking N-terminal amino acids 1-76 of the amino acid sequence set forth in SEQ ID NO:110 (the full-length CsPT4 polypeptide amino acid sequence) was found to readily catalyze the production of cannabigerolic acid from GPP and olivetolic acid, with activity similar to that of the full-length CsPT4 polypeptide. However, other truncated versions of the CsPT4 polypeptide lacking N-terminal amino acids 1-112 (SEQ ID NO:211), 1-131 (SEQ ID NO:213), 1-142 (SEQ ID NO:215), 1-166 (SEQ ID NO:217), or 1-186 (SEQ ID NO:219) were unable to catalyze formation of cannabigerolic acid from GPP and olivetolic acid, suggesting that these truncation polypeptides lacked residues required for catalytic activity.

Surprisingly, it was found that the CsPT4 polypeptide, or a truncated version thereof, has broad substrate specificity, permitting generation of not only cannabinoids, but also cannabinoid derivatives. Because of this broad specificity, olivetolic acid or derivatives thereof produced in genetically modified host cells disclosed herein by TKS and OAC polypeptides can be utilized by a CsPT4 polypeptide, or a truncated version thereof, to afford cannabinoids and cannabinoid derivatives. Alternatively, olivetolic acid or derivatives thereof can be fed to genetically modified host cells disclosed herein comprising a CsPT4 polypeptide, or a truncated version thereof, to afford cannabinoids and cannabinoid derivatives. The cannabinoids and cannabinoid derivatives can then be converted to other cannabinoids or cannabinoid derivatives via a CBDA or THCA synthase polypeptide.

Isolated or Purified Nucleic Acids Encoding GOT Polypeptides

Some embodiments of the disclosure relate to an isolated or purified nucleic acid encoding a GOT polypeptide, wherein said GOT polypeptide can catalyze production of cannabigerolic acid from GPP and olivetolic acid in an amount at least ten times higher than a polypeptide comprising an amino acid sequence set forth in SEQ ID NO:82.

Some embodiments of the disclosure relate to an isolated or purified nucleic acid encoding a GOT polypeptide, a truncated CsPT4 polypeptide (CsPT4t polypeptide, lacking N-terminal amino acids 1-76 of the amino acid sequence set forth in SEQ ID NO:110), comprising the amino acid sequence set forth in SEQ ID NO:100. Some embodiments of the disclosure relate to an isolated or purified nucleic acid encoding a GOT polypeptide, a CsPT4t polypeptide, comprising the amino acid sequence set forth in SEQ ID NO:100, or a conservatively substituted amino acid sequence thereof. Some embodiments of the disclosure relate to an isolated or purified nucleic acid encoding a GOT polypeptide, a CsPT4t polypeptide, comprising an amino acid sequence having at least 65%, at least 70%, or at least 75% amino acid sequence identity to SEQ ID NO:100. Some embodiments of the disclosure relate to an isolated or purified nucleic acid encoding a GOT polypeptide, a CsPT4t polypeptide, comprising an amino acid sequence having at least 80%, at least 81%, at least 82%, at least 83%, or at least 84% amino acid sequence identity to SEQ ID NO:100. Some embodiments of the disclosure relate to an isolated or purified nucleic acid encoding a GOT polypeptide, a CsPT4t polypeptide, comprising an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:100. Some embodiments of the disclosure relate to an isolated or purified nucleic acid encoding a GOT polypeptide, a CsPT4t polypeptide, comprising an amino acid sequence having at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:100.

Some embodiments of the disclosure relate to an isolated or purified nucleic acid encoding a GOT polypeptide, a CsPT4t polypeptide, comprising an amino acid sequence having at least 65% amino acid sequence identity to SEQ ID NO:100. Some embodiments of the disclosure relate to an isolated or purified nucleic acid encoding a GOT polypeptide, a CsPT4t polypeptide, comprising an amino acid sequence having at least 75% amino acid sequence identity to SEQ ID NO:100. Some embodiments of the disclosure relate to an isolated or purified nucleic acid encoding a GOT polypeptide, a CsPT4t polypeptide, comprising an amino acid sequence having at least 85% amino acid sequence identity to SEQ ID NO:100. Some embodiments of the disclosure relate to an isolated or purified nucleic acid encoding a GOT polypeptide, a CsPT4t polypeptide, comprising an amino acid sequence having at least 95% amino acid sequence identity to SEQ ID NO:100. Some embodiments of the disclosure relate to an isolated or purified nucleic acid encoding a GOT polypeptide, a CsPT4t polypeptide, comprising an amino acid sequence having at least 65% amino acid sequence identity to SEQ ID NO:100, or a conservatively substituted amino acid sequence thereof. Some embodiments of the disclosure relate to an isolated or purified nucleic acid encoding a GOT polypeptide, a CsPT4t polypeptide, comprising an amino acid sequence having at least 75% amino acid sequence identity to SEQ ID NO:100, or a conservatively substituted amino acid sequence thereof. Some embodiments of the disclosure relate to an isolated or purified nucleic acid encoding a GOT polypeptide, a CsPT4t polypeptide, comprising an amino acid sequence having at least 85% amino acid sequence identity to SEQ ID NO:100, or a conservatively substituted amino acid sequence thereof. Some embodiments of the disclosure relate to an isolated or purified nucleic acid encoding a GOT polypeptide, a CsPT4t polypeptide, comprising an amino acid sequence having at least 95% amino acid sequence identity to SEQ ID NO:100, or a conservatively substituted amino acid sequence thereof.

Some embodiments of the disclosure relate to an isolated or purified nucleic acid encoding a full-length GOT polypeptide, a CsPT4 polypeptide, comprising the amino acid sequence set forth in SEQ ID NO:110. Some embodiments of the disclosure relate to an isolated or purified nucleic acid encoding a GOT polypeptide, a CsPT4 polypeptide, comprising the amino acid sequence set forth in SEQ ID NO:110, or a conservatively substituted amino acid sequence thereof. Some embodiments of the disclosure relate to an isolated or purified nucleic acid encoding a GOT polypeptide, a CsPT4 polypeptide, comprising an amino acid sequence having at least 65%, at least 70%, or at least 75% amino acid sequence identity to SEQ ID NO:110. Some embodiments of the disclosure relate to an isolated or purified nucleic acid encoding a GOT polypeptide, a CsPT4 polypeptide, comprising an amino acid sequence having at least 80%, at least 81%, at least 82%, at east 83%, or at least 84% amino acid sequence identity to SEQ ID NO:110. Some embodiments of the disclosure relate to an isolated or purified nucleic acid encoding a GOT polypeptide, a CsPT4 polypeptide, comprising an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:110. Some embodiments of the disclosure relate to an isolated or purified nucleic acid encoding a GOT polypeptide, a CsPT4 polypeptide, comprising an amino acid sequence having at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:110.

Some embodiments of the disclosure relate to an isolated or purified nucleic acid encoding a GOT polypeptide, a CsPT4 polypeptide, comprising an amino acid sequence having at least 65% amino acid sequence identity to SEQ ID NO:110. Some embodiments of the disclosure relate to an isolated or purified nucleic acid encoding a GOT polypeptide, a CsPT4 polypeptide, comprising an amino acid sequence having at least 75% amino acid sequence identity to SEQ ID NO:110. Some embodiments of the disclosure relate to an isolated or purified nucleic acid encoding a GOT polypeptide, a CsPT4 polypeptide, comprising an amino acid sequence having at least 85% amino acid sequence identity to SEQ ID NO:110. Some embodiments of the disclosure relate to an isolated or purified nucleic acid encoding a GOT polypeptide, a CsPT4 polypeptide, comprising an amino acid sequence having at least 95% amino acid sequence identity to SEQ ID NO:110. Some embodiments of the disclosure relate to an isolated or purified nucleic acid encoding a GOT polypeptide, a CsPT4 polypeptide, comprising an amino acid sequence having at least 65% amino acid sequence identity to SEQ ID NO:110, or a conservatively substituted amino acid sequence thereof. Some embodiments of the disclosure relate to an isolated or purified nucleic acid encoding a GOT polypeptide, a CsPT4 polypeptide, comprising an amino acid sequence having at least 75% amino acid sequence identity to SEQ ID NO:110, or a conservatively substituted amino acid sequence thereof. Some embodiments of the disclosure relate to an isolated or purified nucleic acid encoding a GOT polypeptide, a CsPT4 polypeptide, comprising an amino acid sequence having at least 85% amino acid sequence identity to SEQ ID NO:110, or a conservatively substituted amino acid sequence thereof. Some embodiments of the disclosure relate to an isolated or purified nucleic acid encoding a GOT polypeptide, a CsPT4 polypeptide, comprising an amino acid sequence having at least 95% amino acid sequence identity to SEQ ID NO:110, or a conservatively substituted amino acid sequence thereof.

Some embodiments of the disclosure relate to an isolated or purified CsPT4 nucleic acid comprising the nucleotide sequence set forth in SEQ ID NO:111. Some embodiments of the disclosure relate to an isolated or purified CsPT4 nucleic acid comprising the nucleotide sequence set forth in SEQ ID NO:111, or a codon degenerate nucleotide sequence thereof. Some embodiments of the disclosure relate to an isolated or purified CsPT4 nucleic acid comprising a nucleotide sequence having at least 80%, at least 81%, at least 82%, at least 83%, or at least 84% sequence identity to SEQ ID NO:111. Some embodiments of the disclosure relate to an isolated or purified CsPT4 nucleic acid comprising a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:111. Some embodiments of the disclosure relate to an isolated or purified CsPT4 nucleic acid comprising a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:111.

Some embodiments of the disclosure relate to an isolated or purified CsPT4 nucleic acid comprising a nucleotide sequence having at least 85% sequence identity to SEQ ID NO:111. Some embodiments of the disclosure relate to an isolated or purified CsPT4 nucleic acid comprising a nucleotide sequence having at least 95% sequence identity to SEQ ID NO:111. Some embodiments of the disclosure relate to an isolated or purified CsPT4 nucleic acid comprising a nucleotide sequence having at least 85% sequence identity to SEQ ID NO:111, or a codon degenerate nucleotide sequence thereof. Some embodiments of the disclosure relate to an isolated or purified CsPT4 nucleic acid comprising a nucleotide sequence having at least 95% sequence identity to SEQ ID NO:111, or a codon degenerate nucleotide sequence thereof.

Some embodiments of the disclosure relate to an isolated or purified CsPT4 nucleic acid comprising the nucleotide sequence set forth in SEQ ID NO:225. Some embodiments of the disclosure relate to an isolated or purified CsPT4 nucleic acid comprising the nucleotide sequence set forth in SEQ ID NO:225, or a codon degenerate nucleotide sequence thereof. Some embodiments of the disclosure relate to an isolated or purified CsPT4 nucleic acid comprising a nucleotide sequence having at least 80%, at least 81%, at least 82%, at least 83%, or at least 84% sequence identity to SEQ ID NO:225. Some embodiments of the disclosure relate to an isolated or purified CsPT4 nucleic acid comprising a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:225. Some embodiments of the disclosure relate to an isolated or purified CsPT4 nucleic acid comprising a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:225.

Some embodiments of the disclosure relate to an isolated or purified CsPT4 nucleic acid comprising a nucleotide sequence having at least 85% sequence identity to SEQ ID NO:225. Some embodiments of the disclosure relate to an isolated or purified CsPT4 nucleic acid comprising a nucleotide sequence having at least 95% sequence identity to SEQ ID NO:225. Some embodiments of the disclosure relate to an isolated or purified CsPT4 nucleic acid comprising a nucleotide sequence having at least 85% sequence identity to SEQ ID NO:225, or a codon degenerate nucleotide sequence thereof. Some embodiments of the disclosure relate to an isolated or purified CsPT4 nucleic acid comprising a nucleotide sequence having at least 95% sequence identity to SEQ ID NO:225, or a codon degenerate nucleotide sequence thereof.

Some embodiments of the disclosure relate to an isolated or purified CsPT4t nucleic acid comprising the nucleotide sequence set forth in SEQ ID NO:224. Some embodiments of the disclosure relate to an isolated or purified CsPT4t nucleic acid comprising the nucleotide sequence set forth in SEQ ID NO:224, or a codon degenerate nucleotide sequence thereof. Some embodiments of the disclosure relate to an isolated or purified CsPT4t nucleic acid comprising a nucleotide sequence having at least 80%, at least 81%, at least 82%, at least 83%, or at least 84% sequence identity to SEQ ID NO:224. Some embodiments of the disclosure relate to an isolated or purified CsPT4t nucleic acid comprising a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:224. Some embodiments of the disclosure relate to an isolated or purified CsPT4t nucleic acid comprising a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:224.

Some embodiments of the disclosure relate to an isolated or purified CsPT4t nucleic acid comprising a nucleotide sequence having at least 85% sequence identity to SEQ ID NO:224. Some embodiments of the disclosure relate to an isolated or purified CsPT4t nucleic acid comprising a nucleotide sequence having at least 95% sequence identity to SEQ ID NO:224. Some embodiments of the disclosure relate to an isolated or purified CsPT4t nucleic acid comprising a nucleotide sequence having at least 85% sequence identity to SEQ ID NO:224, or a codon degenerate nucleotide sequence thereof. Some embodiments of the disclosure relate to an isolated or purified CsPT4t nucleic acid comprising a nucleotide sequence having at least 95% sequence identity to SEQ ID NO:224, or a codon degenerate nucleotide sequence thereof.

Some embodiments of the disclosure relate to an isolated or purified CsPT4t nucleic acid comprising the nucleotide sequence set forth in SEQ ID NO:221. Some embodiments of the disclosure relate to an isolated or purified CsPT4t nucleic acid comprising the nucleotide sequence set forth in SEQ ID NO:221, or a codon degenerate nucleotide sequence thereof. Some embodiments of the disclosure relate to an isolated or purified CsPT4t nucleic acid comprising a nucleotide sequence having at least 80%, at least 81%, at least 82%, at least 83%, or at least 84% sequence identity to SEQ ID NO:221. Some embodiments of the disclosure relate to an isolated or purified CsPT4t nucleic acid comprising a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:221. Some embodiments of the disclosure relate to an isolated or purified CsPT4t nucleic acid comprising a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:221.

Some embodiments of the disclosure relate to an isolated or purified CsPT4t nucleic acid comprising a nucleotide sequence having at least 85% sequence identity to SEQ ID NO:221. Some embodiments of the disclosure relate to an isolated or purified CsPT4t nucleic acid comprising a nucleotide sequence having at least 95% sequence identity to SEQ ID NO:221. Some embodiments of the disclosure relate to an isolated or purified CsPT4t nucleic acid comprising a nucleotide sequence having at least 85% sequence identity to SEQ ID NO:221, or a codon degenerate nucleotide sequence thereof. Some embodiments of the disclosure relate to an isolated or purified CsPT4t nucleic acid comprising a nucleotide sequence having at least 95% sequence identity to SEQ ID NO:221, or a codon degenerate nucleotide sequence thereof.

Further included are nucleic acids that hybridize to the nucleic acids disclosed here. Hybridization conditions may be stringent in that hybridization will occur if there is at least a 90%, 95%, or 97% sequence identity with the nucleotide sequence present in the nucleic acid encoding the polypeptides disclosed herein. The stringent conditions may include those used for known Southern hybridizations such as, for example, incubation overnight at 42° C. in a solution having 50% formamide, 5×SSC (150 mM NaCl, 15 mM trisodium citrate), 50 mM sodium phosphate (pH 7.6), 5×Denhardt's solution, 10% dextran sulfate, and 20 micrograms/milliliter denatured, sheared salmon sperm DNA, following by washing the hybridization support in 0.1×SSC at about 65° C. Other known hybridization conditions are well known and are described in Sambrook et al., Molecular Cloning: A Laboratory Manual, Third Edition, Cold Spring Harbor, N.Y. (2001).

The length of the nucleic acids disclosed herein may depend on the intended use. For example, if the intended use is as a primer or probe, for example for PCR amplification or for screening a library, the length of the nucleic acid will be less than the full length sequence, for example, 15-50 nucleotides. In certain such embodiments, the primers or probes may be substantially identical to a highly conserved region of the nucleotide sequence or may be substantially identical to either the 5' or 3' end of the nucleotide sequence. In some cases, these primers or probes may use universal bases in some positions so as to be "substantially identical" but still provide flexibility in sequence recognition. It is of note that suitable primer and probe hybridization conditions are well known in the art. Also included are cDNA molecules of the disclosed nucleic acids.

Isolated or Purified GOT Polypeptides

Some embodiments of the disclosure relate to an isolated or purified GOT polypeptide, wherein said GOT polypeptide can catalyze production of cannabigerolic acid from GPP and olivetolic acid in an amount at least ten times higher than a polypeptide comprising an amino acid sequence set forth in SEQ ID NO:82.

Some embodiments of the disclosure relate to an isolated or purified GOT polypeptide, a CsPT4t polypeptide, comprising the amino acid sequence set forth in SEQ ID NO:100. Some embodiments of the disclosure relate to an isolated or purified GOT polypeptide, a CsPT4t polypeptide, comprising the amino acid sequence set forth in SEQ ID NO:100, or a conservatively substituted amino acid sequence thereof. Some embodiments of the disclosure relate to an isolated or purified GOT polypeptide, a CsPT4t polypeptide, comprising an amino acid sequence having at least 65%, at least 70%, or at least 75% amino acid sequence identity to SEQ ID NO:100. Some embodiments of the disclosure relate to an isolated or purified GOT polypeptide, a CsPT4t polypeptide, comprising an amino acid sequence having at least 80%, at least 81%, at least 82%, at least 83%, or at least 84% amino acid sequence identity to SEQ ID NO:100. Some embodiments of the disclosure relate to an isolated or purified GOT polypeptide, a CsPT4t polypeptide, comprising an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:100. Some embodiments of the disclosure relate to an isolated or purified GOT polypeptide, a CsPT4t polypeptide, comprising an amino acid sequence having at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:100.

Some embodiments of the disclosure relate to an isolated or purified GOT polypeptide, a CsPT4t polypeptide, comprising an amino acid sequence having at least 65% amino acid sequence identity to SEQ ID NO:100. Some embodiments of the disclosure relate to an isolated or purified GOT polypeptide, a CsPT4t polypeptide, comprising an amino acid sequence having at least 75% amino acid sequence identity to SEQ ID NO:100. Some embodiments of the disclosure relate to an isolated or purified GOT polypeptide, a CsPT4t polypeptide, comprising an amino acid sequence having at least 85% amino acid sequence identity to SEQ ID NO:100. Some embodiments of the disclosure relate to an isolated or purified GOT polypeptide, a CsPT4t polypeptide, comprising an amino acid sequence having at least 95% amino acid sequence identity to SEQ ID NO:100. Some embodiments of the disclosure relate to an isolated or purified GOT polypeptide, a CsPT4t polypeptide, comprising an amino acid sequence having at least 65% amino acid sequence identity to SEQ ID NO:100, or a conservatively substituted amino acid sequence thereof. Some embodiments of the disclosure relate to an isolated or purified GOT polypeptide, a CsPT4t polypeptide, comprising an amino acid sequence having at least 75% amino acid sequence identity to SEQ ID NO:100, or a conservatively substituted amino acid sequence thereof. Some embodiments of the disclosure relate to an isolated or purified GOT polypeptide, a CsPT4t polypeptide, comprising an amino acid sequence having at least 85% amino acid sequence identity to SEQ ID NO:100, or a conservatively substituted amino acid sequence thereof. Some embodiments of the disclosure relate to an isolated or purified GOT polypeptide, a CsPT4t polypeptide, comprising an amino acid sequence having at least 95% amino acid sequence identity to SEQ ID NO:100, or a conservatively substituted amino acid sequence thereof.

Some embodiments of the disclosure relate to an isolated or purified GOT polypeptide, a CsPT4 polypeptide, comprising the amino acid sequence set forth in SEQ ID NO:110. Some embodiments of the disclosure relate to an isolated or purified GOT polypeptide, a CsPT4 polypeptide, comprising the amino acid sequence set forth in SEQ ID NO:110, or a conservatively substituted amino acid sequence thereof. Some embodiments of the disclosure relate to an isolated or purified GOT polypeptide, a CsPT4 polypeptide, comprising an amino acid sequence having at least 65%, at least 70%, or at least 75% amino acid sequence identity to SEQ ID NO:110. Some embodiments of the disclosure relate to an isolated or purified GOT polypeptide, a CsPT4 polypeptide, comprising an amino acid sequence having at least 80%, at least 81%, at least 82%, at least 83%, or at least 84% amino acid sequence identity to SEQ ID NO:110. Some embodiments of the disclosure relate to an isolated or purified GOT polypeptide, a CsPT4 polypeptide, comprising an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:110. Some embodiments of the disclosure relate to an isolated or purified GOT polypeptide, a CsPT4 polypeptide, comprising an amino acid sequence having at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:110.

Some embodiments of the disclosure relate to an isolated or purified GOT polypeptide, a CsPT4 polypeptide, comprising an amino acid sequence having at least 65% amino acid sequence identity to SEQ ID NO:110. Some embodiments of the disclosure relate to an isolated or purified GOT polypeptide, a CsPT4 polypeptide, comprising an amino acid sequence having at least 75% amino acid sequence identity to SEQ ID NO:110. Some embodiments of the disclosure relate to an isolated or purified GOT polypeptide, a CsPT4 polypeptide, comprising an amino acid sequence having at least 85% amino acid sequence identity to SEQ ID NO:110. Some embodiments of the disclosure relate to an isolated or purified GOT polypeptide, a CsPT4 polypeptide, comprising an amino acid sequence having at least 95% amino acid sequence identity to SEQ ID NO:110. Some embodiments of the disclosure relate to an isolated or purified GOT polypeptide, a CsPT4 polypeptide, comprising an amino acid sequence having at least 65% amino acid sequence identity to SEQ ID NO:110, or a conservatively substituted amino acid sequence thereof. Some embodiments of the disclosure relate to an isolated or purified GOT polypeptide, a CsPT4 polypeptide, comprising an amino acid sequence having at least 75% amino acid sequence identity to SEQ ID NO:110, or a conservatively substituted amino acid sequence thereof. Some embodiments of the disclosure relate to an isolated or purified GOT polypeptide, a CsPT4 polypeptide, comprising an amino acid sequence having at least 85% amino acid sequence identity to SEQ ID NO:110, or a conservatively substituted amino acid sequence thereof. Some embodiments of the disclosure relate to an isolated or purified GOT polypeptide, a CsPT4 polypeptide, comprising an amino acid sequence having at least 95% amino acid sequence identity to SEQ ID NO:110, or a conservatively substituted amino acid sequence thereof.

Vectors Comprising Nucleic Acids Encoding GOT Polypeptides

Some embodiments of the disclosure relate to a vector comprising one or more nucleic acids encoding a GOT polypeptide, wherein said GOT polypeptide can catalyze production of cannabigerolic acid from GPP and olivetolic acid in an amount at least ten times higher than a polypeptide comprising an amino acid sequence set forth in SEQ ID NO:82.

Some embodiments of the disclosure relate to a vector comprising one or more nucleic acids encoding a GOT polypeptide, a. CsPT4t polypeptide, comprising the amino acid sequence set forth in SEQ ID NO:100. Some embodiments of the disclosure relate to a vector comprising one or more nucleic acids encoding a GOT polypeptide, a CsPT4t polypeptide, comprising the amino acid sequence set forth in SEQ ID NO:100, or a conservatively substituted amino acid sequence thereof. Some embodiments of the disclosure relate to a vector comprising one or more nucleic acids encoding a GOT polypeptide, a CsPT4t polypeptide, comprising an amino acid sequence having at least 65%, at least 70%, or at least 75% amino acid sequence identity to SEQ ID NO:100. Some embodiments of the disclosure relate to a vector comprising one or more nucleic acids encoding a GOT polypeptide, a CsPT4t polypeptide, comprising an amino acid sequence having at least 80%, at least 81%, at least 82%, at least 83%, or at least 84% amino acid sequence identity to SEQ ID NO:100. Some embodiments of the disclosure relate to a vector comprising one or more nucleic acids encoding a GOT polypeptide, a CsPT4t polypeptide, comprising an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:100. Some embodiments of the disclosure relate to a vector comprising one or more nucleic acids encoding a GOT polypeptide, a CsPT4t polypeptide, comprising an amino acid sequence having at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:100.

Some embodiments of the disclosure relate to a vector comprising one or more nucleic acids encoding a GOT polypeptide, a CsPT4t polypeptide, comprising an amino acid sequence having at least 65% amino acid sequence identity to SEQ ID NO:100. Some embodiments of the disclosure relate to a vector comprising one or more nucleic acids encoding a GOT polypeptide, a CsPT4t polypeptide, comprising an amino acid sequence having at least 75% amino acid sequence identity to SEQ ID NO:100. Some embodiments of the disclosure relate to a vector comprising one or more nucleic acids encoding a GOT polypeptide, a CsPT4t polypeptide, comprising an amino acid sequence having at least 85% amino acid sequence identity to SEQ ID NO:100. Some embodiments of the disclosure relate to a vector comprising one or more nucleic acids encoding a GOT polypeptide, a CsPT4t polypeptide, comprising an amino acid sequence having at least 95% amino acid sequence identity to SEQ ID NO:100. Some embodiments of the disclosure relate to a vector comprising one or more nucleic acids encoding a GOT polypeptide, a CsPT4t polypeptide, comprising an amino acid sequence having at least 65% amino acid sequence identity to SEQ ID NO:100, or a conservatively substituted amino acid sequence thereof. Some embodiments of the disclosure relate to a vector comprising one or more nucleic acids encoding a GOT polypeptide, a CsPT4t polypeptide, comprising an amino acid sequence having at least 75% amino acid sequence identity to SEQ ID NO:100, or a conservatively substituted amino acid sequence thereof. Some embodiments of the disclosure relate to a vector comprising one or more nucleic acids encoding a GOT polypeptide, a CsPT4t polypeptide, comprising an amino acid sequence having at least 85% amino acid sequence identity to SEQ ID NO:100, or a conservatively substituted amino acid sequence thereof. Some embodiments of the disclosure relate to a vector comprising one or more nucleic acids encoding a GOT polypeptide, a CsPT4t polypeptide, comprising an amino acid sequence having at least 95% amino acid sequence identity to SEQ ID NO:100, or a conservatively substituted amino acid sequence thereof.

Some embodiments of the disclosure relate to a vector comprising one or more nucleic acids encoding a GOT polypeptide, a CsPT4 polypeptide, comprising the amino acid sequence set forth in SEQ ID NO:110. Some embodiments of the disclosure relate to a vector comprising one or more nucleic acids encoding a GOT polypeptide, a CsPT4 polypeptide, comprising the amino acid sequence set forth in SEQ ID NO:110, or a conservatively substituted amino acid sequence thereof. Some embodiments of the disclosure relate to a vector comprising one or more nucleic acids encoding a GOT polypeptide, a CsPT4 polypeptide, comprising an amino acid sequence having at least 65%, at least 70%, or at least 75% amino acid sequence identity to SEQ ID NO:110. Some embodiments of the disclosure relate to a vector comprising one or more nucleic acids encoding a GOT polypeptide, a CsPT4 polypeptide, comprising an amino acid sequence having at least 80%, at least 81%, at least 82%, at least 83%, or at least 84% amino acid sequence identity to SEQ ID NO:110. Some embodiments of the disclosure relate to a vector comprising one or more nucleic acids encoding a GOT polypeptide, a CsPT4 polypeptide, comprising an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:110. Some embodiments of the disclosure relate to a vector comprising one or more nucleic acids encoding a GOT polypeptide, a CsPT4 polypeptide, comprising an amino acid sequence having at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:110.

Some embodiments of the disclosure relate to a vector comprising one or more nucleic acids encoding a GOT polypeptide, a CsPT4 polypeptide, comprising an amino acid sequence having at least 65% amino acid sequence identity to SEQ ID NO:110. Some embodiments of the disclosure relate to a vector comprising one or more nucleic acids encoding a GOT polypeptide, a CsPT4 polypeptide, comprising an amino acid sequence having at least 75% amino acid sequence identity to SEQ ID NO:110. Some embodiments of the disclosure relate to a vector comprising one or more nucleic acids encoding a GOT polypeptide, a CsPT4 polypeptide, comprising an amino acid sequence having at least 85% amino acid sequence identity to SEQ ID NO:110. Some embodiments of the disclosure relate to a vector comprising one or more nucleic acids encoding a GOT polypeptide, a CsPT4 polypeptide, comprising an amino acid sequence having at least 95% amino acid sequence identity to SEQ ID NO:110. Some embodiments of the disclosure relate to a vector comprising one or more nucleic acids encoding a GOT polypeptide, a CsPT4 polypeptide, comprising an amino acid sequence having at least 65% amino acid sequence identity to SEQ ID NO:110, or a conservatively substituted amino acid sequence thereof. Some embodiments of the disclosure relate to a vector comprising one or more nucleic acids encoding a GOT polypeptide, a CsPT4 polypeptide, comprising an amino acid sequence having at least 75% amino acid sequence identity to SEQ ID NO:110, or a conservatively substituted amino acid sequence thereof. Some embodiments of the disclosure relate to a vector comprising one or more nucleic acids encoding a GOT polypeptide, a CsPT4 polypeptide, comprising an amino acid sequence having at least 85% amino acid sequence identity to SEQ ID NO:110, or a conservatively substituted amino acid sequence thereof. Some embodiments of the disclosure relate to a vector comprising one or more nucleic acids encoding a GOT polypeptide, a CsPT4 polypeptide, comprising an amino acid sequence having at least 95% amino acid sequence identity to SEQ ID NO:110, or a conservatively substituted amino acid sequence thereof.

Some embodiments of the disclosure relate to a vector comprising a CsPT4 nucleic acid comprising the nucleotide sequence set forth in SEQ ID NO:111. Some embodiments of the disclosure relate to a vector comprising a CsPT4 nucleic acid comprising the nucleotide sequence set forth in SEQ ID NO:111, or a codon degenerate nucleotide sequence thereof. Some embodiments of the disclosure relate to a vector comprising a CsPT4 nucleic acid comprising a nucleotide sequence having at least 80%, at least 81%, at least 82%, at least 83%, or at least 84% sequence identity to SEQ ID NO:111. Some embodiments of the disclosure relate to a vector comprising a CsPT4 nucleic acid comprising a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:111. Some embodiments of the disclosure relate to a vector comprising a CsPT4 nucleic acid comprising a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:111.

Some embodiments of the disclosure relate to a vector comprising a CsPT4 nucleic acid comprising a nucleotide sequence having at least 85% sequence identity to SEQ ID NO:111. Some embodiments of the disclosure relate to a vector comprising a CsPT4 nucleic acid comprising a nucleotide sequence having at least 95% sequence identity to SEQ ID NO:111. Some embodiments of the disclosure relate to a vector comprising a CsPT4 nucleic acid comprising a nucleotide sequence having at least 85% sequence identity to SEQ ID NO:111, or a codon degenerate nucleotide sequence thereof. Some embodiments of the disclosure relate to a vector comprising a CsPT4 nucleic acid comprising a nucleotide sequence having at least 95% sequence identity to SEQ ID NO:111, or a codon degenerate nucleotide sequence thereof.

Some embodiments of the disclosure relate to a vector comprising a CsPT4 nucleic acid comprising the nucleotide sequence set forth in SEQ ID NO:225. Some embodiments of the disclosure relate to a vector comprising a CsPT4 nucleic acid comprising the nucleotide sequence set forth in SEQ ID NO:225, or a codon degenerate nucleotide sequence thereof. Some embodiments of the disclosure relate to a vector comprising a CsPT4 nucleic acid comprising a nucleotide sequence having at least 80%, at least 81%, at least 82%, at least 83%, or at least 84% sequence identity to SEQ ID NO:225. Some embodiments of the disclosure relate to a vector comprising a CsPT4 nucleic acid comprising a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:225. Some embodiments of the disclosure relate to a vector comprising a CsPT4 nucleic acid comprising a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:225.

Some embodiments of the disclosure relate to a vector comprising a CsPT4 nucleic acid comprising a nucleotide sequence having at least 85% sequence identity to SEQ ID NO:225. Some embodiments of the disclosure relate to a vector comprising a CsPT4 nucleic acid comprising a nucleotide sequence having at least 95% sequence identity to SEQ ID NO:225. Some embodiments of the disclosure relate to a vector comprising a CsPT4 nucleic acid comprising a nucleotide sequence having at least 85% sequence identity to SEQ ID NO:225, or a codon degenerate nucleotide sequence thereof. Some embodiments of the disclosure relate to a vector comprising a CsPT4 nucleic acid comprising a nucleotide sequence having at least 95% sequence identity to SEQ ID NO:225, or a codon degenerate nucleotide sequence thereof.

Some embodiments of the disclosure relate to a vector comprising a CsPT4t nucleic acid comprising the nucleotide sequence set forth in SEQ ID NO:221. Some embodiments of the disclosure relate to a vector comprising a CsPT4t nucleic acid comprising the nucleotide sequence set forth in SEQ ID NO:221, or a codon degenerate nucleotide sequence thereof. Some embodiments of the disclosure relate to a vector comprising a CsPT4t nucleic acid comprising a nucleotide sequence having at least 80%, at least 81%, at least 82%, at least 83%, or at least 84% sequence identity to SEQ ID NO:221. Some embodiments of the disclosure relate to a vector comprising a CsPT4t nucleic acid comprising a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:221. Some embodiments of the disclosure relate to a vector comprising a CsPT4t nucleic acid comprising a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:221.

Some embodiments of the disclosure relate to a vector comprising a CsPT4t nucleic acid comprising a nucleotide sequence having at least 85% sequence identity to SEQ ID NO:221. Some embodiments of the disclosure relate to a vector comprising a CsPT4t nucleic acid comprising a nucleotide sequence having at least 95% sequence identity to SEQ ID NO:221. Some embodiments of the disclosure relate to a vector comprising a CsPT4t nucleic acid comprising a nucleotide sequence having at least 85% sequence identity to SEQ ID NO:221, or a codon degenerate nucleotide sequence thereof. Some embodiments of the disclosure relate to a vector comprising a CsPT4t nucleic acid comprising a nucleotide sequence having at least 95% sequence identity to SEQ ID NO:221, or a codon degenerate nucleotide sequence thereof.

Some embodiments of the disclosure relate to a vector comprising a CsPT4t nucleic acid comprising the nucleotide sequence set forth in SEQ ID NO:224. Some embodiments of the disclosure relate to a vector comprising a CsPT4t nucleic acid comprising the nucleotide sequence set forth in SEQ ID NO:224, or a codon degenerate nucleotide sequence thereof. Some embodiments of the disclosure relate to a vector comprising a CsPT4t nucleic acid comprising a nucleotide sequence having at least 80%, at least 81%, at least 82%, at least 83%, or at least 84% sequence identity to SEQ ID NO:224. Some embodiments of the disclosure relate to a vector comprising a CsPT4t nucleic acid comprising a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:224. Some embodiments of the disclosure relate to a vector comprising a CsPT4t nucleic acid comprising a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:224.

Some embodiments of the disclosure relate to a vector comprising a CsPT4t nucleic acid comprising a nucleotide sequence having at least 85% sequence identity to SEQ ID NO:224. Some embodiments of the disclosure relate to a vector comprising a CsPT4t nucleic acid comprising a nucleotide sequence having at least 95% sequence identity to SEQ ID NO:224. Some embodiments of the disclosure relate to a vector comprising a CsPT4t nucleic acid comprising a nucleotide sequence having at least 85% sequence identity to SEQ ID NO:224, or a codon degenerate nucleotide sequence thereof. Some embodiments of the disclosure relate to a vector comprising a CsPT4t nucleic acid comprising a nucleotide sequence having at least 95% sequence identity to SEQ ID NO:224, or a codon degenerate nucleotide sequence thereof.

Expression Constructs Comprising Nucleic Acids Encoding GOT Polypeptides

Some embodiments of the disclosure relate to an expression construct comprising one or more nucleic acids encoding a GOT polypeptide, wherein said. GOT polypeptide can catalyze production of cannabigerolic acid from GPP and olivetolic acid in an amount at least ten times higher than a polypeptide comprising an amino acid sequence set forth in SEQ ID NO:82.

Some embodiments of the disclosure relate to an expression construct comprising one or more nucleic acids encoding a GOT polypeptide, a CsPT4t polypeptide, comprising the amino acid sequence set forth in SEQ ID NO:100. Some embodiments of the disclosure relate to an expression construct comprising one or more nucleic acids encoding a GOT polypeptide, a CsPT4t polypeptide, comprising the amino acid sequence set forth in SEQ ID NO:100, or a conservatively substituted amino acid sequence thereof. Some embodiments of the disclosure relate to an expression construct comprising one or more nucleic acids encoding a GOT polypeptide, a CsPT4t polypeptide, comprising an amino acid sequence having at least 65%, at least 70%, or at least 75% amino acid sequence identity to SEQ ID NO:100. Some embodiments of the disclosure relate to an expression construct comprising one or more nucleic acids encoding a GOT polypeptide, a CsPT4t polypeptide, comprising an amino acid sequence having at least 80%, at least 81%, at least 82%, at least 83%, or at least 84% amino acid sequence identity to SEQ ID NO:100. Some embodiments of the disclosure relate to an expression construct comprising one or more nucleic acids encoding a GOT polypeptide, a CsPT4t polypeptide, comprising an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:100. Some embodiments of the disclosure relate to an expression construct comprising one or more nucleic acids encoding a GOT polypeptide, a CsPT4t polypeptide, comprising an amino acid sequence having at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:100.

Some embodiments of the disclosure relate to an expression construct comprising one or more nucleic acids encoding a GOT polypeptide, a CsPT4t polypeptide, comprising an amino acid sequence having at least 65% amino acid sequence identity to SEQ ID NO:100. Some embodiments of the disclosure relate to an expression construct comprising one or more nucleic acids encoding a GOT polypeptide, a CsPT4t polypeptide, comprising an amino acid sequence having at least 75% amino acid sequence identity to SEQ ID NO:100. Some embodiments of the disclosure relate to an expression construct comprising one or more nucleic acids encoding a GOT polypeptide, a CsPT4t polypeptide, comprising an amino acid sequence having at least 85% amino acid sequence identity to SEQ ID NO:100. Some embodiments of the disclosure relate to an expression construct comprising one or more nucleic acids encoding a GOT polypeptide, a CsPT4t polypeptide, comprising an amino acid sequence having at least 95% amino acid sequence identity to SEQ ID NO:100. Some embodiments of the disclosure relate to an expression construct comprising one or more nucleic acids encoding a GOT polypeptide, a CsPT4t polypeptide, comprising an amino acid sequence having at least 65% amino acid sequence identity to SEQ ID NO:100, or a conservatively substituted amino acid sequence thereof. Some embodiments of the disclosure relate to an expression construct comprising one or more nucleic acids encoding a GOT polypeptide, a CsPT4t polypeptide, comprising an amino acid sequence having at least 75% amino acid sequence identity to SEQ ID NO:100, or a conservatively substituted amino acid sequence thereof. Some embodiments of the disclosure relate to an expression construct comprising one or more nucleic acids encoding a GOT polypeptide, a CsPT4t polypeptide, comprising an amino acid sequence having at least 85% amino acid sequence identity to SEQ ID NO:100, or a conservatively substituted amino acid sequence thereof. Some embodiments of the disclosure relate to an expression construct comprising one or more nucleic acids encoding a GOT polypeptide, a CsPT4t polypeptide, comprising an amino acid sequence having at least 95% amino acid sequence identity to SEQ ID NO:100, or a conservatively substituted amino acid sequence thereof.

Some embodiments of the disclosure relate to an expression construct comprising one or more nucleic acids encoding a GOT polypeptide, a CsPT4 polypeptide, comprising the amino acid sequence set forth in SEQ ID NO:110. Some embodiments of the disclosure relate to an expression construct comprising one or more nucleic acids encoding a GOT polypeptide, a CsPT4 polypeptide, comprising the amino acid sequence set forth in SEQ ID NO:110, or a conservatively substituted amino acid sequence thereof. Some embodiments of the disclosure relate to an expression construct comprising one or more nucleic acids encoding a GOT polypeptide, a CsPT4 polypeptide, comprising an amino acid sequence having at least 65%, at least 70%, or at least 75% amino acid sequence identity to SEQ ID NO:110. Some embodiments of the disclosure relate to an expression construct comprising one or more nucleic acids encoding a GOT polypeptide, a CsPT4 polypeptide, comprising an amino acid sequence having at least 80%, at least 81%, at least 82%, at least 83%, or at least 84% amino acid sequence identity to SEQ ID NO:110. Some embodiments of the disclosure relate to an expression construct comprising one or more nucleic acids encoding a GOT polypeptide, a CsPT4 polypeptide, comprising an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:110. Some embodiments of the disclosure relate to an expression construct comprising one or more nucleic acids encoding a GOT polypeptide, a CsPT4 polypeptide, comprising an amino acid sequence having at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:110.

Some embodiments of the disclosure relate to an expression construct comprising one or more nucleic acids encoding a GOT polypeptide, a CsPT4 polypeptide, comprising an amino acid sequence having at least 65% amino acid sequence identity to SEQ ID NO:110. Some embodiments of the disclosure relate to an expression construct comprising one or more nucleic acids encoding a GOT polypeptide, a CsPT4 polypeptide, comprising an amino acid sequence having at least 75% amino acid sequence identity to SEQ ID NO:110. Some embodiments of the disclosure relate to an expression construct comprising one or more nucleic acids encoding a GOT polypeptide, a CsPT4 polypeptide, comprising an amino acid sequence having at least 85% amino acid sequence identity to SEQ ID NO:110. Some embodiments of the disclosure relate to an expression construct comprising one or more nucleic acids encoding a GOT polypeptide, a CsPT4 polypeptide, comprising an amino acid sequence having at least 95% amino acid sequence identity to SEQ ID NO:110. Some embodiments of the disclosure relate to an expression construct comprising one or more nucleic acids encoding a GOT polypeptide, a CsPT4 polypeptide, comprising an amino acid sequence having at least 65% amino acid sequence identity to SEQ ID NO:110, or a conservatively substituted amino acid sequence thereof. Some embodiments of the disclosure relate to an expression construct comprising one or more nucleic acids encoding a GOT polypeptide, a CsPT4 polypeptide, comprising an amino acid sequence having at least 75% amino acid sequence identity to SEQ ID NO:110, or a conservatively substituted amino acid sequence thereof. Some embodiments of the disclosure relate to an expression construct comprising one or more nucleic acids encoding a GOT polypeptide, a CsPT4 polypeptide, comprising an amino acid sequence having at least 85% amino acid sequence identity to SEQ ID NO:110, or a conservatively substituted amino acid sequence thereof. Some embodiments of the disclosure relate to an expression construct comprising one or more nucleic acids encoding a GOT polypeptide, a CsPT4 polypeptide, comprising an amino acid sequence having at least 95% amino acid sequence identity to SEQ ID NO:110, or a conservatively substituted amino acid sequence thereof.

Some embodiments of the disclosure relate to an expression construct comprising a CsPT4 nucleic acid comprising the nucleotide sequence set forth in SEQ ID NO:111. Some embodiments of the disclosure relate to an expression construct comprising a CsPT4 nucleic acid comprising the nucleotide sequence set forth in SEQ ID NO:111, or a codon degenerate nucleotide sequence thereof. Some embodiments of the disclosure relate to an expression construct comprising a CsPT4 nucleic acid comprising a nucleotide sequence having at least 80%, at least 81%, at least 82%, at least 83%, or at least 84% sequence identity to SEQ ID NO:111. Some embodiments of the disclosure relate to an expression construct comprising a CsPT4 nucleic acid comprising a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:111. Some embodiments of the disclosure relate to an expression construct comprising a CsPT4 nucleic acid comprising a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:111. Some embodiments of the disclosure relate to an expression construct comprising a CsPT4 nucleic acid comprising a nucleotide sequence having at least 85% sequence identity to SEQ ID NO:111, or a codon degenerate nucleotide sequence thereof. Some embodiments of the disclosure relate to an expression construct comprising a CsPT4 nucleic acid comprising a nucleotide sequence having at least 95% sequence identity to SEQ ID NO:111, or a codon degenerate nucleotide sequence thereof.

Some embodiments of the disclosure relate to an expression construct comprising a CsPT4 nucleic acid comprising the nucleotide sequence set forth in SEQ ID NO:225. Some embodiments of the disclosure relate to an expression construct comprising a CsPT4 nucleic acid comprising the nucleotide sequence set forth in SEQ ID NO:225, or a codon degenerate nucleotide sequence thereof. Some embodiments of the disclosure relate to an expression construct comprising a CsPT4 nucleic acid comprising a nucleotide sequence having at least 80%, at least 81%, at least 82%, at least 83%, or at least 84% sequence identity to SEQ ID NO:225. Some embodiments of the disclosure relate to an expression construct comprising a CsPT4 nucleic acid comprising a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:225. Some embodiments of the disclosure relate to an expression construct comprising a CsPT4 nucleic acid comprising a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:225.

Some embodiments of the disclosure relate to an expression construct comprising a CsPT4 nucleic acid comprising a nucleotide sequence having at least 85% sequence identity to SEQ ID NO:225. Some embodiments of the disclosure relate to an expression construct comprising a CsPT4 nucleic acid comprising a nucleotide sequence having at least 95% sequence identity to SEQ ID NO:225. Some embodiments of the disclosure relate to an expression construct comprising a CsPT4 nucleic acid comprising a nucleotide sequence having at least 85% sequence identity to SEQ ID NO:225, or a codon degenerate nucleotide sequence thereof. Some embodiments of the disclosure relate to an expression construct comprising a CsPT4 nucleic acid comprising a nucleotide sequence having at least 95% sequence identity to SEQ ID NO:225, or a codon degenerate nucleotide sequence thereof.

Some embodiments of the disclosure relate to an expression construct comprising a CsPT4t nucleic acid comprising the nucleotide sequence set forth in SEQ ID NO:221. Some embodiments of the disclosure relate to an expression construct comprising a CsPT4t nucleic acid comprising the nucleotide sequence set forth in SEQ ID NO:221, or a codon degenerate nucleotide sequence thereof. Some embodiments of the disclosure relate to an expression construct comprising a CsPT4t nucleic acid comprising a nucleotide sequence having at least 80%, at least 81%, at least 82%, at least 83%, or at least 84% sequence identity to SEQ ID NO:221. Some embodiments of the disclosure relate to an expression construct comprising a CsPT4t nucleic acid comprising a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:221. Some embodiments of the disclosure relate to an expression construct comprising a CsPT4t nucleic acid comprising a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:221.

Some embodiments of the disclosure relate to an expression construct comprising a CsPT4t nucleic acid comprising a nucleotide sequence having at least 85% sequence identity to SEQ ID NO:221. Some embodiments of the disclosure relate to an expression construct comprising a CsPT4t nucleic acid comprising a nucleotide sequence having at least 95% sequence identity to SEQ ID NO:221. Some embodiments of the disclosure relate to an expression construct comprising a CsPT4t nucleic acid comprising a nucleotide sequence having at least 85% sequence identity to SEQ ID NO:221, or a codon degenerate nucleotide sequence thereof. Some embodiments of the disclosure relate to an expression construct comprising a CsPT4t nucleic acid comprising a nucleotide sequence having at least 95% sequence identity to SEQ ID NO:221, or a codon degenerate nucleotide sequence thereof.

Some embodiments of the disclosure relate to an expression construct comprising a CsPT4t nucleic acid comprising the nucleotide sequence set forth in SEQ ID NO: 224. Some embodiments of the disclosure relate to an expression construct comprising a CsPT4t nucleic acid comprising the nucleotide sequence set forth in SEQ ID NO:224, or a codon degenerate nucleotide sequence thereof. Some embodiments of the disclosure relate to an expression construct comprising a CsPT4t nucleic acid comprising a nucleotide sequence having at least 80%, at least 81%, at least 82%, at least 83%, or at least 84% sequence identity to SEQ ID NO:224. Some embodiments of the disclosure relate to an expression construct comprising a CsPT4t nucleic acid comprising a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:224. Some embodiments of the disclosure relate to an expression construct comprising a CsPT4t nucleic acid comprising a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:224.

Some embodiments of the disclosure relate to an expression construct comprising a CsPT4t nucleic acid comprising a nucleotide sequence having at least 85% sequence identity to SEQ ID NO:224. Some embodiments of the disclosure relate to an expression construct comprising a CsPT4t nucleic acid comprising a nucleotide sequence having at least 95% sequence identity to SEQ ID NO:224. Some embodiments of the disclosure relate to an expression construct comprising a CsPT4t nucleic acid comprising a nucleotide sequence having at least 85% sequence identity to SEQ ID NO:224, or a codon degenerate nucleotide sequence thereof. Some embodiments of the disclosure relate to an expression construct comprising a CsPT4t nucleic acid comprising a nucleotide sequence having at least 95% sequence identity to SEQ ID NO:224, or a codon degenerate nucleotide sequence thereof.

Polypeptides, Nucleic Acids, and Genetically Modified Host Cells for the Production of Cannabinoids, Cannabinoid Derivatives, Cannabinoid Precursors, or Cannabinoid Precursor Derivatives The present disclosure provides genetically modified host cells for producing a cannabinoid, a cannabinoid derivative, a cannabinoid precursor, or a cannabinoid precursor derivative. A genetically modified host cell of the present disclosure may be genetically modified with one or more heterologous nucleic acids disclosed herein encoding one or more polypeptides disclosed herein. Culturing of the genetically modified host cell in a suitable medium provides for synthesis of the cannabinoid, the cannabinoid derivative, the cannabinoid precursor, or the cannabinoid precursor derivative in a recoverable amount. In some embodiments, the genetically modified host cell of the disclosure produces a cannabinoid or a cannabinoid derivative.

The disclosure also provides nucleic acids, which can be introduced into microorganisms (e.g., genetically modified host cells), resulting in expression or overexpression of the one or more polypeptides, which can then be utilized in vitro (e.g., cell-free) or in vivo for the production of cannabinoids, cannabinoid derivatives, cannabinoid precursors, or cannabinoid precursor derivatives. In certain such embodiments, cannabinoids or cannabinoid derivatives are produced.

One or more polypeptides which can be utilized for the production of a cannabinoid, a cannabinoid derivative, a cannabinoid precursor, or a cannabinoid precursor derivative are disclosed herein, and may include, but are not limited to: one or more polypeptides having at least one activity of a polypeptide present in the cannabinoid biosynthetic pathway, such as, a GOT polypeptide, a CBDA or THCA synthase polypeptide, a TKS polypeptide, and an OAC polypeptide; one or more polypeptides having at least one activity of a polypeptide present in the mevalonate (MEV) pathway; a polypeptide that generates acyl-CoA compounds or acyl-CoA compound derivatives (e.g., an acyl-activating enzyme polypeptide, a fatty acyl-CoA synthetase polypeptide, or a fatty acyl-CoA ligase polypeptide); a polypeptide that generates GPP; a polypeptide that generates malonyl-CoA; a polypeptide that condenses two molecules of acetyl-CoA to generate acetoacetyl-CoA, and a pyruvate decarboxylase polypeptide. Additionally, polypeptides which can be utilized for the production of a cannabinoid, a cannabinoid derivative, a cannabinoid precursor, or a cannabinoid precursor derivative may be one or more polypeptides having at least one activity of a polypeptide present in the DXP pathway, instead of those of the MEV pathway.

Polypeptides which can be utilized for the production of a cannabinoid, a cannabinoid derivative, a cannabinoid precursor, or a cannabinoid precursor derivative may also include a hexanoyl-CoA synthase (HCS) polypeptide or one or more polypeptides that are part of a biosynthetic pathway that produces hexanoyl-CoA, including, but not limited to: a MCT1 polypeptide, a PaaH1 polypeptide, a Crt polypeptide, a Ter polypeptide, and a BktB polypeptide; a MCT1 polypeptide, a PhaB polypeptide, a PhaJ polypeptide, a Ter polypeptide, and a BktB polypeptide; a short chain fatty acyl-CoA thioesterase (SCFA-TE) polypeptide; or a fatty acid synthase (FAS) polypeptide. Hexanoyl CoA derivatives, acyl-CoA compounds, or acyl-CoA compound derivatives may also be formed via such pathways and polypeptides.

Polypeptides which can be utilized for the production of a cannabinoid, a cannabinoid derivative, a cannabinoid precursor, or a cannabinoid precursor derivative may also include polypeptides that modulate NADH or NADPH redox balance, polypeptides that generate neryl pyrophosphate, and NphB polypeptides.

The disclosure also provides nucleic acids encoding said polypeptides which can be utilized for the production of a cannabinoid, a cannabinoid derivative, a cannabinoid precursor, or a cannabinoid precursor derivative. The disclosure also provides genetically modified host cells comprising one or more of said nucleic acids and polypeptides which can be utilized for the production of a cannabinoid, a cannabinoid derivative, a cannabinoid precursor, or a cannabinoid precursor derivative.

Geranyl Pyrophosphate:Olivetolic Acid Geranyltransferase (GOT) Polypeptides, Nucleic Acids, and Genetically Modified Host Cells Expressing Said Polypeptides In some embodiments, a genetically modified host cell of the present disclosure is genetically modified with one or more heterologous nucleic acids encoding a geranyl pyrophosphate:olivetolic acid geranyltransferase (GOT) polypeptide.

Exemplary GOT polypeptides disclosed herein may include a full-length GOT polypeptide, a fragment of a GOT polypeptide, a variant of a GOT polypeptide, a truncated GOT polypeptide, or a fusion polypeptide that has at least one activity of a GOT polypeptide. In some embodiments, the GOT polypeptide has aromatic prenyltransferase (PT) activity. In some embodiments, the GOT polypeptide modifies a cannabinoid precursor or a cannabinoid precursor derivative. In certain such embodiments, the GOT polypeptide modifies olivetolic acid or an olivetolic acid derivative. In some embodiments, the GOT polypeptide cannot catalyze the production of 5-geranyl olivetolic acid.

In some embodiments, a genetically modified host cell of the present disclosure is genetically modified with one or more heterologous nucleic acids encoding a GOT polypeptide, wherein said GOT polypeptide can catalyze production of cannabigerolic acid from GPP and olivetolic acid in an amount at least ten times higher than a polypeptide comprising an amino acid sequence set forth in SEQ ID NO:82. In some embodiments, a genetically modified host cell of the present disclosure is genetically modified with one or more heterologous nucleic acids encoding a GOT polypeptide, wherein said GOT polypeptide can catalyze production of cannabigerolic acid from GPP and olivetolic acid in an amount at least 200-500 times higher than a polypeptide comprising an amino acid sequence set forth in SEQ ID NO:82. In some embodiments, a genetically modified host cell of the present disclosure is genetically modified with one or more heterologous nucleic acids encoding a GOT polypeptide, wherein said GOT polypeptide can catalyze production of cannabigerolic acid from GPP and olivetolic acid in an amount at least 10, at least 20, at least 30, at least 40, at least 50, at least 60, at least 70, at least 80, at least 90, at least 100, at least 200, at least 300, at least 400, or at least 500 times higher than a polypeptide comprising an amino acid sequence set forth in SEQ ID NO:82. In some embodiments, a genetically modified host cell of the present disclosure is genetically modified with one or more heterologous nucleic acids encoding a GOT polypeptide, wherein said GOT polypeptide can catalyze production of cannabigerolic acid from GPP and olivetolic acid in an amount at least 10-50, at least 50-100, at least 100-200, at least 100-300, at least 100-400, at least 200-400, at least 100-500, at least 200-500, or at least 300-500 times higher than a polypeptide comprising an amino acid sequence set forth in SEQ ID NO:82.

In some embodiments, the GOT polypeptide encoded by the one or more heterologous nucleic acids comprises the amino acid sequence set forth in SEQ ID NO:100 or SEQ ID NO:110. In some embodiments, the GOT polypeptide encoded by the one or more heterologous nucleic acids comprises the amino acid sequence set forth in SEQ ID NO:100 or SEQ ID NO:110, or a conservatively substituted amino acid sequence thereof. In some embodiments, the GOT polypeptide encoded by the one or more heterologous nucleic acids comprises an amino acid sequence having at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:100 or SEQ ID NO:110.

In some embodiments, the GOT polypeptide encoded by the one or more heterologous nucleic acids comprises the amino acid sequence set forth in SEQ ID NO:12, SEQ ID NO:82, SEQ ID NO:98, SEQ ID NO:99, or SEQ ID NO:223. In some embodiments, the GOT polypeptide encoded by the one or more heterologous nucleic acids comprises the amino acid sequence set forth in SEQ ID NO:12, SEQ ID NO:82, SEQ ID NO:98, SEQ ID NO:99, or SEQ ID NO:223, or a conservatively substituted amino acid sequence thereof. In some embodiments, the GOT polypeptide encoded by the one or more heterologous nucleic acids comprises an amino acid sequence having at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:12, SEQ ID NO:82, SEQ ID NO:98, SEQ ID NO:99, or SEQ ID NO:223.

In some embodiments, the GOT polypeptide encoded by the one or more heterologous nucleic acids comprises the amino acid sequence set forth in SEQ ID NO:13, SEQ ID NO:101, SEQ ID NO:102, or SEQ ID NO:103. In some embodiments, the GOT polypeptide encoded by the one or more heterologous nucleic acids comprises the amino acid sequence set forth in SEQ ID NO:13, SEQ ID NO:101, SEQ ID NO:102, or SEQ ID NO:103, or a conservatively substituted amino acid sequence thereof. In some embodiments, the GOT polypeptide encoded by the one or more heterologous nucleic acids comprises an amino acid sequence having at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:13, SEQ ID NO:101, SEQ ID NO:102, or SEQ ID NO:103.

In some embodiments, the GOT polypeptide encoded by the one or more heterologous nucleic acids comprises the amino acid sequence set forth in SEQ ID NO:211, SEQ ID NO:213, SEQ ID NO:215, SEQ ID NO:217, or SEQ ID NO:219. In some embodiments, the GOT polypeptide encoded by the one or more heterologous nucleic acids comprises the amino acid sequence set forth in SEQ ID NO:211, SEQ ID NO:213, SEQ ID NO:215, SEQ ID NO:217, or SEQ ID NO:219, or a conservatively substituted amino acid sequence thereof. In some embodiments, the GOT polypeptide encoded by the one or more heterologous nucleic acids comprises an amino acid sequence having at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:211, SEQ ID NO:213, SEQ ID NO:215, SEQ ID NO:217, or SEQ ID NO:219.

In some embodiments, the GOT polypeptide encoded by the one or more heterologous nucleic acids comprises the amino acid sequence set forth in SEQ ID NO:12. In some embodiments, the GOT polypeptide encoded by the one or more heterologous nucleic acids comprises the amino acid sequence set forth in SEQ ID NO:12, or a conservatively substituted amino acid sequence thereof. In some embodiments, the GOT polypeptide encoded by the one or more heterologous nucleic acids comprises an amino acid sequence having at least 65%, at least 70%, or at least 75% amino acid sequence identity to SEQ ID NO:12. In some embodiments, the GOT polypeptide encoded by the one or more heterologous nucleic acids comprises an amino acid sequence having at least 80%, at least 81%, at least 82%, at least 83%, or at least 84% amino acid sequence identity to SEQ ID NO:12. In some embodiments, the GOT polypeptide encoded by the one or more heterologous nucleic acids comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:12.

In some embodiments, the GOT polypeptide encoded by the one or more heterologous nucleic acids comprises the amino acid sequence set forth in SEQ ID NO:13. In some embodiments, the GOT polypeptide encoded by the one or more heterologous nucleic acids comprises the amino acid sequence set forth in SEQ ID NO:13, or a conservatively substituted amino acid sequence thereof. In some embodiments, the GOT polypeptide encoded by the one or more heterologous nucleic acids comprises an amino acid sequence having at least 65%, at least 70%, or at least 75% amino acid sequence identity to SEQ ID NO:13. In some embodiments, the GOT polypeptide encoded by the one or more heterologous nucleic acids comprises an amino acid sequence having at least 80%, at least 81%, at least 82%, at least 83%, or at least 84% amino acid sequence identity to SEQ ID NO:13. In some embodiments, the GOT polypeptide encoded by the one or more heterologous nucleic acids comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:13.

In some embodiments, the GOT polypeptide encoded by the one or more heterologous nucleic acids is a CsPT1 polypeptide and comprises the amino acid sequence set forth in SEQ ID NO:82. In some embodiments, the GOT polypeptide encoded by the one or more heterologous nucleic acids is a CsPT1 polypeptide and comprises the amino acid sequence set forth in SEQ ID NO:82, or a conservatively substituted amino acid sequence thereof. In some embodiments, the GOT polypeptide encoded by the one or more heterologous nucleic acids is a CsPT1 polypeptide and comprises an amino acid sequence having at least 65%, at least 70%, or at least 75% amino acid sequence identity to SEQ ID NO:82. In some embodiments, the GOT polypeptide encoded by the one or more heterologous nucleic acids is a CsPT1 polypeptide and comprises an amino acid sequence having at least 80%, at least 81%, at least 82%, at least 83%, or at least 84% amino acid sequence identity to SEQ ID NO:82. In some embodiments, the GOT polypeptide encoded by the one or more heterologous nucleic acids is a CsPT1 polypeptide and comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:82.

In some embodiments, the GOT polypeptide encoded by the one or more heterologous nucleic acids is a truncated CsPT1 (CsPT1_t75) polypeptide and comprises the amino acid sequence set forth in SEQ ID NO:223. In some embodiments, the GOT polypeptide encoded by the one or more heterologous nucleic acids is a CsPT1_t75 polypeptide and comprises the amino acid sequence set forth in SEQ ID NO:223, or a conservatively substituted amino acid sequence thereof. In some embodiments, the GOT polypeptide encoded by the one or more heterologous nucleic acids is a CsPT1_t75 polypeptide and comprises an amino acid sequence having at least 65%, at least 70%, or at least 75% amino acid sequence identity to SEQ ID NO:223. In some embodiments, the GOT polypeptide encoded by the one or more heterologous nucleic acids is a CsPT1_t75 polypeptide and comprises an amino acid sequence having at least 80%, at least 81%, at least 82%, at least 83%, or at least 84% amino acid sequence identity to SEQ ID NO:223. In some embodiments, the GOT polypeptide encoded by the one or more heterologous nucleic acids is a CsPT1_t75 polypeptide and comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:223.

In some embodiments, the GOT polypeptide encoded by the one or more heterologous nucleic acids is a CsGOTt75 polypeptide and comprises the amino acid sequence set forth in SEQ ID NO:98. In some embodiments, the GOT polypeptide encoded by the one or more heterologous nucleic acids is a CsGOTt75 polypeptide and comprises the amino acid sequence set forth in SEQ ID NO:98, or a conservatively substituted amino acid sequence thereof. In some embodiments, the GOT polypeptide encoded by the one or more heterologous nucleic acids is a CsGOTt75 polypeptide and comprises an amino acid sequence having at least 65%, at least 70%, or at least 75% amino acid sequence identity to SEQ ID NO:98. In some embodiments, the GOT polypeptide encoded by the one or more heterologous nucleic acids is a CsGOTt75 polypeptide and comprises an amino acid sequence having at least 80%, at least 81%, at least 82%, at least 83%, or at least 84% amino acid sequence identity to SEQ ID NO:98. In some embodiments, the GOT polypeptide encoded by the one or more heterologous nucleic acids is a CsGOTt75 polypeptide and comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 993%, at least 99.8%, at least 99.9%, or 100% amino acid sequence identity to SEQ ID NO:98.

In some embodiments, the GOT polypeptide encoded by the one or more heterologous nucleic acids is a CsGOTt33 polypeptide and comprises the amino acid sequence set forth in SEQ ID NO:99. In some embodiments, the GOT polypeptide encoded by the one or more heterologous nucleic acids is a CsGOTt33 polypeptide and comprises the amino acid sequence set forth in SEQ ID NO:99, or a conservatively substituted amino acid sequence thereof. In some embodiments, the GOT polypeptide encoded by the one or more heterologous nucleic acids is a CsGOTt33 polypeptide and comprises an amino acid sequence having at least 65%, at least 70%, or at least 75% amino acid sequence identity to SEQ ID NO:99. In some embodiments, the GOT polypeptide encoded by the one or more heterologous nucleic acids is a CsGOTt33 polypeptide and comprises an amino acid sequence having at least 80%, at least 81%, at least 82%, at least 83%, or at least 84% amino acid sequence identity to SEQ ID NO:99. In some embodiments, the GOT polypeptide encoded by the one or more heterologous nucleic acids is a CsGOTt33 polypeptide and comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:99.

In some embodiments, the GOT polypeptide encoded by the one or more heterologous nucleic acids is a CsPT4t polypeptide and comprises the amino acid sequence set forth in SEQ ID NO:100. In some embodiments, the GOT polypeptide encoded by the one or more heterologous nucleic acids is a CsPT4t polypeptide and comprises the amino acid sequence set forth in SEQ ID NO:100, or a conservatively substituted amino acid sequence thereof. In some embodiments, the GOT polypeptide encoded by the one or more heterologous nucleic acids is a CsPT4t polypeptide and comprises an amino acid sequence having at least 65%, at least 70%, or at least 75% amino acid sequence identity to SEQ ID NO:100. In some embodiments, the GOT polypeptide encoded by the one or more heterologous nucleic acids is a CsPT4t polypeptide and comprises an amino acid sequence having at least 80%, at least 81%, at least 82%, at least 83%, or at least 84% amino acid sequence identity to SEQ ID NO:100. In some embodiments, the GOT polypeptide encoded by the one or more heterologous nucleic acids is a CsPT4t polypeptide and comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:100. In some embodiments, the GOT polypeptide encoded by the one or more heterologous nucleic acids is a CsPT4t polypeptide and comprises an amino acid sequence having at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:100.

In some embodiments, the GOT polypeptide encoded by the one or more heterologous nucleic acids is a CsPT4t polypeptide and comprises an amino acid sequence having at least 65% amino acid sequence identity to SEQ ID NO:100. In some embodiments, the GOT polypeptide encoded by the one or more heterologous nucleic acids is a CsPT4t polypeptide and comprises an amino acid sequence having at least 75% amino acid sequence identity to SEQ ID NO:100. In some embodiments, the GOT polypeptide encoded by the one or more heterologous nucleic acids is a CsPT4t polypeptide and comprises an amino acid sequence having at least 85% amino acid sequence identity to SEQ ID NO:100. In some embodiments, the GOT polypeptide encoded by the one or more heterologous nucleic acids is a CsPT4t polypeptide and comprises an amino acid sequence having at least 95% amino acid sequence identity to SEQ ID NO:100. In some embodiments, the GOT polypeptide encoded by the one or more heterologous nucleic acids is a CsPT4t polypeptide and comprises an amino acid sequence having at least 65% amino acid sequence identity to SEQ ID NO:100, or a conservatively substituted amino acid sequence thereof. In some embodiments, the GOT polypeptide encoded by the one or more heterologous nucleic acids is a CsPT4t polypeptide and comprises an amino acid sequence having at least 75% amino acid sequence identity to SEQ ID NO:100, or a conservatively substituted amino acid sequence thereof. In some embodiments, the GOT polypeptide encoded by the one or more heterologous nucleic acids is a CsPT4t polypeptide and comprises an amino acid sequence having at least 85% amino acid sequence identity to SEQ ID NO:100, or a conservatively substituted amino acid sequence thereof. In some embodiments, the GOT polypeptide encoded by the one or more heterologous nucleic acids is a CsPT4t polypeptide and comprises an amino acid sequence having at least 95% amino acid sequence identity to SEQ ID NO:100, or a conservatively substituted amino acid sequence thereof.

In some embodiments, the GOT polypeptide encoded by the one or more heterologous nucleic acids is a CsPT7t polypeptide and comprises the amino acid sequence set forth in SEQ ID NO:101. In some embodiments, the GOT polypeptide encoded by the one or more heterologous nucleic acids is a CsPT7t polypeptide and comprises the amino acid sequence set forth in SEQ ID NO:101, or a conservatively substituted amino acid sequence thereof. In some embodiments, the GOT polypeptide encoded by the one or more heterologous nucleic acids is a CsPT7t polypeptide and comprises an amino acid sequence having at least 65%, at least 70%, or at least 75% amino acid sequence identity to SEQ ID NO:101. In some embodiments, the GOT polypeptide encoded by the one or more heterologous nucleic acids is a CsPT7t polypeptide and comprises an amino acid sequence having at least 80%, at least 81%, at least 82%, at least 83%, or at least 84% amino acid sequence identity to SEQ ID NO:101. In some embodiments, the GOT polypeptide encoded by the one or more heterologous nucleic acids is a CsPT7t polypeptide and comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:101.

In some embodiments, the GOT polypeptide encoded by the one or more heterologous nucleic acids is a H1PT1Lt polypeptide and comprises the amino acid sequence set forth in SEQ ID NO:102. In some embodiments, the GOT polypeptide encoded by the one or more heterologous nucleic acids is a H1PT1Lt polypeptide and comprises the amino acid sequence set forth in SEQ ID NO:102, or a conservatively substituted amino acid sequence thereof. In some embodiments, the GOT polypeptide encoded by the one or more heterologous nucleic acids is a H1PT1Lt polypeptide and comprises an amino acid sequence having at least 65%, at least 70%, or at least 75% amino acid sequence identity to SEQ ID NO:102. In some embodiments, the GOT polypeptide encoded by the one or more heterologous nucleic acids is a H1PT1Lt polypeptide and comprises an amino acid sequence having at least 80%, at least 81%, at least 82%, at least 83%, or at least 84% amino acid sequence identity to SEQ ID NO:102. In some embodiments, the GOT polypeptide encoded by the one or more heterologous nucleic acids is a H1PT1Lt polypeptide and comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:102.

In some embodiments, the GOT polypeptide encoded by the one or more heterologous nucleic acids is a H1PT2Lt polypeptide and comprises the amino acid sequence set forth in SEQ ID NO:103. In some embodiments, the GOT polypeptide encoded by the one or more heterologous nucleic acids is a H1PT2Lt polypeptide and comprises the amino acid sequence set forth in SEQ ID NO:103, or a conservatively substituted amino acid sequence thereof. In some embodiments, the GOT polypeptide encoded by the one or more heterologous nucleic acids is a H1PT2Lt polypeptide and comprises an amino acid sequence having at least 65%, at least 70%, or at least 75% amino acid sequence identity to SEQ ID NO:103. In some embodiments, the GOT polypeptide encoded by the one or more heterologous nucleic acids is a H1PT2Lt polypeptide and comprises an amino acid sequence having at least 80%, at least 81%, at least 82%, at least 83%, or at least 84% amino acid sequence identity to SEQ ID NO:103. In some embodiments, the GOT polypeptide encoded by the one or more heterologous nucleic acids is a H1PT2Lt polypeptide and comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:103.

In some embodiments, the GOT polypeptide encoded by the one or more heterologous nucleic acids is a CsPT4 polypeptide and comprises the amino acid sequence set forth in SEQ ID NO:110. In some embodiments, the GOT polypeptide encoded by the one or more heterologous nucleic acids is a CsPT4 polypeptide and comprises the amino acid sequence set forth in SEQ ID NO:110, or a conservatively substituted amino acid sequence thereof. In some embodiments, the GOT polypeptide encoded by the one or more heterologous nucleic acids is a CsPT4 polypeptide and comprises an amino acid sequence having at least 65%, at least 70%, or at least 75% amino acid sequence identity to SEQ ID NO:110. In some embodiments, the GOT polypeptide encoded by the one or more heterologous nucleic acids is a CsPT4 polypeptide and comprises an amino acid sequence having at least 80%, at least 81%, at least 82%, at least 83%, or at least 84% amino acid sequence identity to SEQ ID NO:110. In some embodiments, the GOT polypeptide encoded by the one or more heterologous nucleic acids is a CsPT4 polypeptide and comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:110. In some embodiments, the GOT polypeptide encoded by the one or more heterologous nucleic acids is a CsPT4 polypeptide and comprises an amino acid sequence having at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:110.

In some embodiments, the GOT polypeptide encoded by the one or more heterologous nucleic acids is a CsPT4 polypeptide and comprises an amino acid sequence having at least 65% amino acid sequence identity to SEQ ID NO:110. In some embodiments, the GOT polypeptide encoded by the one or more heterologous nucleic acids is a CsPT4 polypeptide and comprises an amino acid sequence having at least 75% amino acid sequence identity to SEQ ID NO:110. In some embodiments, the GOT polypeptide encoded by the one or more heterologous nucleic acids is a CsPT4 polypeptide and comprises an amino acid sequence having at least 85% amino acid sequence identity to SEQ ID NO:110. In some embodiments, the GOT polypeptide encoded by the one or more heterologous nucleic acids is a CsPT4 polypeptide and comprises an amino acid sequence having at least 95% amino acid sequence identity to SEQ ID NO:110. In some embodiments, the GOT polypeptide encoded by the one or more heterologous nucleic acids is a CsPT4 polypeptide and comprises an amino acid sequence having at least 65% amino acid sequence identity to SEQ ID NO:110, or a conservatively substituted amino acid sequence thereof. In some embodiments, the GOT polypeptide encoded by the one or more heterologous nucleic acids is a CsPT4 polypeptide and comprises an amino acid sequence having at least 75% amino acid sequence identity to SEQ ID NO:110, or a conservatively substituted amino acid sequence thereof. In some embodiments, the GOT polypeptide encoded by the one or more heterologous nucleic acids is a CsPT4 polypeptide and comprises an amino acid sequence having at least 85% amino acid sequence identity to SEQ ID NO:110, or a conservatively substituted amino acid sequence thereof. In some embodiments, the GOT polypeptide encoded by the one or more heterologous nucleic acids is a CsPT4 polypeptide and comprises an amino acid sequence having at least 95% amino acid sequence identity to SEQ ID NO:110, or a conservatively substituted amino acid sequence thereof.

In some embodiments, the GOT polypeptide encoded by the one or more heterologous nucleic acids is a truncated CsPT4 (CsPT4_t112) polypeptide and comprises the amino acid sequence set forth in SEQ ID NO:211. In some embodiments, the GOT polypeptide encoded by the one or more heterologous nucleic acids is a CsPT4_t112 polypeptide and comprises the amino acid sequence set forth in SEQ ID NO:211, or a conservatively substituted amino acid sequence thereof. In some embodiments, the GOT polypeptide encoded by the one or more heterologous nucleic acids is a CsPT4_t112 polypeptide and comprises an amino acid sequence having at least 65%, at least 70%, or at least 75% amino acid sequence identity to SEQ ID NO:211. In some embodiments, the GOT polypeptide encoded by the one or more heterologous nucleic acids is a CsPT4_t112 polypeptide and comprises an amino acid sequence having at least 80%, at least 81%, at least 82%, at least 83%, or at least 84% amino acid sequence identity to SEQ ID NO:211. In some embodiments, the GOT polypeptide encoded by the one or more heterologous nucleic acids is a CsPT4_t112 polypeptide and comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:211.

In some embodiments, the GOT polypeptide encoded by the one or more heterologous nucleic acids is a truncated CsPT4 (CsPT4_t131) polypeptide and comprises the amino acid sequence set forth in SEQ ID NO:213. In some embodiments, the GOT polypeptide encoded by the one or more heterologous nucleic acids is a CsPT4_t131 polypeptide and comprises the amino acid sequence set forth in SEQ ID NO:213, or a conservatively substituted amino acid sequence thereof. In some embodiments, the GOT polypeptide encoded by the one or more heterologous nucleic acids is a CsPT4_t131 polypeptide and comprises an amino acid sequence having at least 65%, at least 70%, or at least 75% amino acid sequence identity to SEQ ID NO:213. In some embodiments, the GOT polypeptide encoded by the one or more heterologous nucleic acids is a CsPT4_t131 polypeptide and comprises an amino acid sequence having at least 80%, at least 81%, at least 82%, at least 83%, or at least 84% amino acid sequence identity to SEQ ID NO:213. In some embodiments, the GOT polypeptide encoded by the one or more heterologous nucleic acids is a CsPT4_t131 polypeptide and comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:213.

In some embodiments, the GOT polypeptide encoded by the one or more heterologous nucleic acids is a truncated CsPT4 (CsPT4_t142) polypeptide and comprises the amino acid sequence set forth in SEQ ID NO:215. In some embodiments, the GOT polypeptide encoded by the one or more heterologous nucleic acids is a CsPT4_t142 polypeptide and comprises the amino acid sequence set forth in SEQ ID NO:215, or a conservatively substituted amino acid sequence thereof. In some embodiments, the GOT polypeptide encoded by the one or more heterologous nucleic acids is a CsPT4_t142 polypeptide and comprises an amino acid sequence having at least 65%, at least 70%, or at least 75% amino acid sequence identity to SEQ ID NO:215. In some embodiments, the GOT polypeptide encoded by the one or more heterologous nucleic acids is a CsPT4_t142 polypeptide and comprises an amino acid sequence having at least 80%, at least 81%, at least 82%, at least 83%, or at least 84% amino acid sequence identity to SEQ ID NO:215. In some embodiments, the GOT polypeptide encoded by the one or more heterologous nucleic acids is a CsPT4_t142 polypeptide and comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:215.

In some embodiments, the GOT polypeptide encoded by the one or more heterologous nucleic acids is a truncated CsPT4 (CsPT4_t166) polypeptide and comprises the amino acid sequence set forth in SEQ ID NO:217. In some embodiments, the GOT polypeptide encoded by the one or more heterologous nucleic acids is a CsPT4_t166 polypeptide and comprises the amino acid sequence set forth in SEQ ID NO:217, or a conservatively substituted amino acid sequence thereof. In some embodiments, the GOT polypeptide encoded by the one or more heterologous nucleic acids is a CsPT4_t166 polypeptide and comprises an amino acid sequence having at least 65%, at least 70%, or at least 75% amino acid sequence identity to SEQ ID NO:217. In some embodiments, the GOT polypeptide encoded by the one or more heterologous nucleic acids is a CsPT4_t166 polypeptide and comprises an amino acid sequence having at least 80%, at least 81%, at least 82%, at least 83%, or at least 84% amino acid sequence identity to SEQ ID NO:217. In some embodiments, the GOT polypeptide encoded by the one or more heterologous nucleic acids is a CsPT4_t166 polypeptide and comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:217.

In some embodiments, the GOT polypeptide encoded by the one or more heterologous nucleic acids is a truncated CsPT4 (CsPT4_t186) polypeptide and comprises the amino acid sequence set forth in SEQ ID NO:219. In some embodiments, the GOT polypeptide encoded by the one or more heterologous nucleic acids is a CsPT4_t186 polypeptide and comprises the amino acid sequence set forth in SEQ ID NO:219, or a conservatively substituted amino acid sequence thereof. In some embodiments, the GOT polypeptide encoded by the one or more heterologous nucleic acids is a CsPT4_t186 polypeptide and comprises an amino acid sequence having at least 65%, at least 70%, or at least 75% amino acid sequence identity to SEQ ID NO:219. In some embodiments, the GOT polypeptide encoded by the one or more heterologous nucleic acids is a CsPT4_t186 polypeptide and comprises an amino acid sequence having at least 80%, at least 81%, at least 82%, at least 83%, or at least 84% amino acid sequence identity to SEQ ID NO:219. In some embodiments, the GOT polypeptide encoded by the one or more heterologous nucleic acids is a CsPT4_t186 polypeptide and comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:219.

Exemplary GOT heterologous nucleic acids disclosed herein may include nucleic acids that encode a GOT polypeptide, such as, a full-length GOT polypeptide, a fragment of a GOT polypeptide, a variant of a GOT polypeptide, a truncated GOT polypeptide, or a fusion polypeptide that has at least one activity of a GOT polypeptide.

In some embodiments, the GOT polypeptide is overexpressed in the genetically modified host cell. Overexpression may be achieved by increasing the copy number of the GOT polypeptide-encoding heterologous nucleic acid, e.g., through use of a high copy number expression vector (e.g., a plasmid that exists at 10-40 copies per cell) and/or by operably linking the GOT polypeptide-encoding heterologous nucleic acid to a strong promoter. In some embodiments, the genetically modified host cell has one copy of a GOT polypeptide-encoding heterologous nucleic acid. In some embodiments, the genetically modified host cell has two copies of a GOT polypeptide-encoding heterologous nucleic acid. In some embodiments, the genetically modified host cell has three copies of a GOT polypeptide-encoding heterologous nucleic acid. In some embodiments, the genetically modified host cell has four copies of a GOT polypeptide-encoding heterologous nucleic acid. In some embodiments, the genetically modified host cell has five copies of a GOT polypeptide-encoding heterologous nucleic acid. In some embodiments, the genetically modified host cell has four copies of a GOT polypeptide-encoding heterologous nucleic acid. In some embodiments, the genetically modified host cell has six copies of a GOT polypeptide-encoding heterologous nucleic acid. In some embodiments, the genetically modified host cell has four copies of a GOT polypeptide-encoding heterologous nucleic acid. In some embodiments, the genetically modified host cell has seven copies of a GOT polypeptide-encoding heterologous nucleic acid. In some embodiments, the genetically modified host cell has four copies of a GOT polypeptide-encoding heterologous nucleic acid. In some embodiments, the genetically modified host cell has eight copies of a GOT polypeptide-encoding heterologous nucleic acid.

In some embodiments, the one or more heterologous nucleic acids encoding a GOT polypeptide comprise a nucleotide sequence encoding a GOT polypeptide, wherein said GOT polypeptide can catalyze production of cannabigerolic acid from GPP and olivetolic acid in an amount at least ten times higher than a polypeptide comprising an amino acid sequence set forth in SEQ ID NO:82.

In some embodiments, the one or more heterologous nucleic acids encoding a GOT polypeptide comprise the nucleotide sequence set forth in SEQ ID NO:111, SEQ ID NO:221, SEQ ID NO:224, or SEQ ID NO:225. In some embodiments, the one or more heterologous nucleic acids encoding a GOT polypeptide comprise the nucleotide sequence set forth in SEQ ID NO:111, SEQ ID NO:221, SEQ ID NO:224, or SEQ ID NO:225, or a codon degenerate nucleotide sequence thereof. In some embodiments, the one or more heterologous nucleic acids encoding a GOT polypeptide comprise a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:111, SEQ ID NO:221, SEQ ID NO:224, or SEQ ID NO:225.

In some embodiments, the one or more heterologous nucleic acids encoding a GOT polypeptide comprise the nucleotide sequence set forth in SEQ ID NO:220 or SEQ ID NO:222. In some embodiments, the one or more heterologous nucleic acids encoding a GOT polypeptide comprise the nucleotide sequence set forth in SEQ ID NO:220 or SEQ ID NO:222, or a codon degenerate nucleotide sequence thereof. In some embodiments, the one or more heterologous nucleic acids encoding a GOT polypeptide comprise a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:220 or SEQ ID NO:222.

In some embodiments, the one or more heterologous nucleic acids encoding a GOT polypeptide comprise the nucleotide sequence set forth in SEQ ID NO:210, SEQ ID NO:212, SEQ ID NO:214, SEQ ID NO:216, or SEQ ID NO:218. In some embodiments, the one or more heterologous nucleic acids encoding a GOT polypeptide comprise the nucleotide sequence set forth in SEQ ID NO:210, SEQ ID NO:212, SEQ ID NO:214, SEQ ID NO:216, or SEQ ID NO:218, or a codon degenerate nucleotide sequence thereof. In some embodiments, the one or more heterologous nucleic acids encoding a GOT polypeptide comprise a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:210, SEQ ID NO:212, SEQ ID NO:214, SEQ ID NO:216, or SEQ ID NO:218.

In some embodiments, the one or more heterologous nucleic acids encoding a CsPT4 polypeptide comprise the nucleotide sequence set forth in SEQ ID NO:111. In some embodiments, the one or more heterologous nucleic acids encoding a CsPT4 polypeptide comprise the nucleotide sequence set forth in SEQ ID NO:111, or a codon degenerate nucleotide sequence thereof. In some embodiments, the one or more heterologous nucleic acids encoding a CsPT4 polypeptide comprise a nucleotide sequence having at least 80%, at least 81%, at least 82%, at least 83%, or at least 84% sequence identity to SEQ ID NO:111. In some embodiments, the one or more heterologous nucleic acids encoding a CsPT4 polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:111. In some embodiments, the one or more heterologous nucleic acids encoding a CsPT4 polypeptide comprise a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:111.

In some embodiments, the one or more heterologous nucleic acids encoding a CsPT4 polypeptide comprise a nucleotide sequence having at least 85% sequence identity to SEQ ID NO:111. In some embodiments, the one or more heterologous nucleic acids encoding a CsPT4 polypeptide comprise a nucleotide sequence having at least 95% sequence identity to SEQ ID NO:111. In some embodiments, the one or more heterologous nucleic acids encoding a CsPT4 polypeptide comprise a nucleotide sequence having at least 85% sequence identity to SEQ ID NO:111, or a codon degenerate nucleotide sequence thereof. In some embodiments, the one or more heterologous nucleic acids encoding a CsPT4 polypeptide comprise a nucleotide sequence having at least 95% sequence identity to SEQ ID NO:111, or a codon degenerate nucleotide sequence thereof.

In some embodiments, the one or more heterologous nucleic acids encoding a CsPT4 polypeptide comprise the nucleotide sequence set forth in SEQ ID NO:225. In some embodiments, the one or more heterologous nucleic acids encoding a CsPT4 polypeptide comprise the nucleotide sequence set forth in SEQ ID NO:225, or a codon degenerate nucleotide sequence thereof. In some embodiments, the one or more heterologous nucleic acids encoding a CsPT4 polypeptide, comprise a nucleotide sequence having at least 80%, at least 81%, at least 82%, at least 83%, or at least 84% sequence identity to SEQ ID NO:225. In some embodiments, the one or more heterologous nucleic acids encoding a CsPT4 polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:225. In some embodiments, the one or more heterologous nucleic acids encoding a CsPT4 polypeptide comprise a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:225.

In some embodiments, the one or more heterologous nucleic acids encoding a CsPT4 polypeptide comprise a nucleotide sequence having at least 85% sequence identity to SEQ ID NO:225. In some embodiments, the one or more heterologous nucleic acids encoding a CsPT4 polypeptide comprise a nucleotide sequence having at least 95% sequence identity to SEQ ID NO:225. In some embodiments, the one or more heterologous nucleic acids encoding a CsPT4 polypeptide comprise a nucleotide sequence having at least 85% sequence identity to SEQ ID NO:225, or a codon degenerate nucleotide sequence thereof. In some embodiments, the one or more heterologous nucleic acids encoding a CsPT4 polypeptide comprise a nucleotide sequence having at least 95% sequence identity to SEQ ID NO:225, or a codon degenerate nucleotide sequence thereof.

In some embodiments, the one or more heterologous nucleic acids encoding a CsPT4t polypeptide comprise the nucleotide sequence set forth in SEQ ID NO:221. In some embodiments, the one or more heterologous nucleic acids encoding a CsPT4t polypeptide comprise the nucleotide sequence set forth in SEQ ID NO:221, or a codon degenerate nucleotide sequence thereof. In some embodiments, the one or more heterologous nucleic acids encoding a CsPT4t polypeptide comprise a nucleotide sequence having at least 80%, at least 81%, at least 82%, at least 83%, or at least 84% sequence identity to SEQ ID NO:221. In some embodiments, the one or more heterologous nucleic acids encoding a CsPT4t polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:221. In some embodiments, the one or more heterologous nucleic acids encoding a CsPT4t polypeptide comprise a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:221.

In some embodiments, the one or more heterologous nucleic acids encoding a CsPT4t polypeptide comprise a nucleotide sequence having at least 85% sequence identity to SEQ ID NO:221. In some embodiments, the one or more heterologous nucleic acids encoding a CsPT4t polypeptide comprise a nucleotide sequence having at least 95% sequence identity to SEQ ID NO:221. In some embodiments, the one or more heterologous nucleic acids encoding a CsPT4t polypeptide comprise a nucleotide sequence having at least 85% sequence identity to SEQ ID NO:221, or a codon degenerate nucleotide sequence thereof. In some embodiments, the one or more heterologous nucleic acids encoding a CsPT4t polypeptide comprise a nucleotide sequence having at least 95% sequence identity to SEQ ID NO:221, or a codon degenerate nucleotide sequence thereof.

In some embodiments, the one or more heterologous nucleic acids encoding a CsPT4t polypeptide comprise the nucleotide sequence set forth in SEQ ID NO:224. In some embodiments, the one or more heterologous nucleic acids encoding a CsPT4t polypeptide comprise the nucleotide sequence set forth in SEQ ID NO:224, or a codon degenerate nucleotide sequence thereof. In some embodiments, the one or more heterologous nucleic acids encoding a CsPT4t polypeptide comprise a nucleotide sequence having at least 80%, at least 81%, at least 82%, at least 83%, or at least 84% sequence identity to SEQ ID NO:224. In some embodiments, the one or more heterologous nucleic acids encoding a CsPT4t polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:224. In some embodiments, the one or more heterologous nucleic acids encoding a CsPT4t polypeptide comprise a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:224.

In some embodiments, the one or more heterologous nucleic acids encoding a CsPT4t polypeptide comprise a nucleotide sequence having at least 85% sequence identity to SEQ ID NO:224. In some embodiments, the one or more heterologous nucleic acids encoding a CsPT4t polypeptide comprise a nucleotide sequence having at least 95% sequence identity to SEQ ID NO:224. In some embodiments, the one or more heterologous nucleic acids encoding a CsPT4t polypeptide comprise a nucleotide sequence having at least 85% sequence identity to SEQ ID NO:224, or a codon degenerate nucleotide sequence thereof. In some embodiments, the one or more heterologous nucleic acids encoding a CsPT4t polypeptide comprise a nucleotide sequence having at least 95% sequence identity to SEQ ID NO:224, or a codon degenerate nucleotide sequence thereof.

In some embodiments, the one or more heterologous nucleic acids encoding a CsPT4_t112 polypeptide comprise the nucleotide sequence set forth in SEQ ID NO:210. In some embodiments, the one or more heterologous nucleic acids encoding a CsPT4_t112 polypeptide comprise the nucleotide sequence set forth in SEQ ID NO:210, or a codon degenerate nucleotide sequence thereof. In some embodiments, the one or more heterologous nucleic acids encoding a CsPT4_t112 polypeptide comprise a nucleotide sequence having at least 80%, at least 81%, at least 82%, at least 83%, or at least 84% sequence identity to SEQ ID NO:210. In some embodiments, the one or more heterologous nucleic acids encoding a CsPT4_t112 polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:210. In some embodiments, the one or more heterologous nucleic acids encoding a CsPT4_t112 polypeptide comprise a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:210.

In some embodiments, the one or more heterologous nucleic acids encoding a CsPT4_t131 polypeptide comprise the nucleotide sequence set forth in SEQ ID NO:212. In some embodiments, the one or more heterologous nucleic acids encoding a CsPT4_t131 polypeptide comprise the nucleotide sequence set forth in SEQ ID NO:212, or a codon degenerate nucleotide sequence thereof. In some embodiments, the one or more heterologous nucleic acids encoding a CsPT4_t131 polypeptide comprise a nucleotide sequence having at least 80%, at least 81%, at least 82%, at least 83%, or at least 84% sequence identity to SEQ ID NO:212. In some embodiments, the one or more heterologous nucleic acids encoding a CsPT4_t131 polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:212. In some embodiments, the one or more heterologous nucleic acids encoding a CsPT4_t131 polypeptide comprise a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:212.

In some embodiments, the one or more heterologous nucleic acids encoding a CsPT4_t142 polypeptide comprise the nucleotide sequence set forth in SEQ ID NO:214. In some embodiments, the one or more heterologous nucleic acids encoding a CsPT4_t142 polypeptide comprise the nucleotide sequence set forth in SEQ ID NO:214, or a codon degenerate nucleotide sequence thereof. In some embodiments, the one or more heterologous nucleic acids encoding a CsPT4_t142 polypeptide comprise a nucleotide sequence having at least 80%, at least 81%, at least 82%, at least 83%, or at least 84% sequence identity to SEQ ID NO:214. In some embodiments, the one or more heterologous nucleic acids encoding a CsPT4_t142 polypeptide comprise a nucleotide sequence having at least 85%, at least 86%, at least 87%, at least 88%, at least 89%, at least 90%, at least 91&, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:214. In some embodiments, the one or more heterologous nucleic acids encoding a CsPT4_t142 polypeptide comprise a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:214.

In some embodiments, the one or more heterologous nucleic acids encoding a CsPT4_t166 polypeptide comprise the nucleotide sequence set forth in SEQ ID NO:216. In some embodiments, the one or more heterologous nucleic acids encoding a CsPT4_t166 polypeptide comprise the nucleotide sequence set forth in SEQ ID NO:216, or a codon degenerate nucleotide sequence thereof. In some embodiments, the one or more heterologous nucleic acids encoding a CsPT4_t166 polypeptide comprise a nucleotide sequence having at least 80%, at least 81%, at least 82%, at least 83%, or at least 84% sequence identity to SEQ ID NO:216. In some embodiments, the one or more heterologous nucleic acids encoding a CsPT4_t166 polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:216. In some embodiments, the one or more heterologous nucleic acids encoding a CsPT4_t166 polypeptide comprise a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:216.

In some embodiments, the one or more heterologous nucleic acids encoding a CsPT4_t186 polypeptide comprise the nucleotide sequence set forth in SEQ ID NO:218. In some embodiments, the one or more heterologous nucleic acids encoding a CsPT4_t186 polypeptide comprise the nucleotide sequence set forth in SEQ ID NO:218, or a codon degenerate nucleotide sequence thereof. In some embodiments, the one or more heterologous nucleic acids encoding a CsPT4_t186 polypeptide comprise a nucleotide sequence having at least 80%, at least 81%, at least 82%, at least 83%, or at least 84% sequence identity to SEQ ID NO:218. In some embodiments, the one or more heterologous nucleic acids encoding a CsPT4_t186 polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:218. In some embodiments, the one or more heterologous nucleic acids encoding a CsPT4_t186 polypeptide comprise a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:218.

In some embodiments, the one or more heterologous nucleic acids encoding a CsPT1 polypeptide comprise the nucleotide sequence set forth in SEQ ID NO:220. In some embodiments, the one or more heterologous nucleic acids encoding a CsPT1 polypeptide comprise the nucleotide sequence set forth in SEQ ID NO:220, or a codon degenerate nucleotide sequence thereof. In some embodiments, the one or more heterologous nucleic acids encoding a CsPT1 polypeptide comprise a nucleotide sequence having at least 80%, at least 81%, at least 82%, at least 83%, or at least 84% sequence identity to SEQ ID NO:220. In some embodiments, the one or more heterologous nucleic acids encoding a CsPT1 polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:220. In some embodiments, the one or more heterologous nucleic acids encoding a CsPT1 polypeptide comprise a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:220.

In some embodiments, the one or more heterologous nucleic acids encoding a CsPT1_t75 polypeptide comprise the nucleotide sequence set forth in SEQ ID NO:222. In some embodiments, the one or more heterologous nucleic acids encoding a CsPT1_t75 polypeptide comprise the nucleotide sequence set forth in SEQ ID NO:222, or a codon degenerate nucleotide sequence thereof. In some embodiments, the one or more heterologous nucleic acids encoding a CsPT1_t75 polypeptide comprise a nucleotide sequence having at least 80%, at least 81%, at least 82%, at least 83%, or at least 84% sequence identity to SEQ ID NO:222. In some embodiments, the one or more heterologous nucleic acids encoding a CsPT1_t75 polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:222. In some embodiments, the one or more heterologous nucleic acids encoding a CsPT1_t75 polypeptide comprise a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:222.

Cannabinoid Synthase Polypeptides, Nucleic Acids Comprising Said Polypeptides, and Genetically Modified Host Cells Expressing Said Polypeptides In some embodiments, a genetically modified host cell of the present disclosure is genetically modified with one or more heterologous nucleic acids encoding a cannabinoid synthase polypeptide.

In some embodiments, a genetically modified host cell of the present disclosure is genetically modified with one or more heterologous nucleic acids encoding more than one cannabinoid synthase polypeptide. In some embodiments, a genetically modified host cell of the present disclosure is genetically modified with one or more heterologous nucleic acids encoding more than two cannabinoid synthase polypeptides. In some embodiments, a genetically modified host cell of the present disclosure is genetically modified with one or more heterologous nucleic acids encoding more than three cannabinoid synthase polypeptides. In some embodiments, a genetically modified host cell of the present disclosure is genetically modified with one or more heterologous nucleic acids encoding two cannabinoid synthase polypeptides. In some embodiments, a genetically modified host cell of the present disclosure is genetically modified with one or more heterologous nucleic acids encoding three cannabinoid synthase polypeptides. In some embodiments, a genetically modified host cell of the present disclosure is genetically modified with one or more heterologous nucleic acids encoding 1, 2, 3, or more cannabinoid synthase polypeptides. In some embodiments, a genetically modified host cell of the present disclosure is genetically modified with one or more heterologous nucleic acids encoding 1, 2, or 3 cannabinoid synthase polypeptides.

In some embodiments, a cannabinoid synthase polypeptide is a tetrahydrocannabinolic acid synthase (THCAS) polypeptide. THCAS polypeptides can catalyze the conversion of cannabigerolic acid to THCA. Exemplary THCAS polypeptides disclosed herein may include a fragment of a THCAS polypeptide, a full-length THCAS polypeptide, a variant of a THCAS polypeptide, a truncated THCAS polypeptide, or a fusion polypeptide that has at least one activity of a THCAS polypeptide.

In some embodiments, a genetically modified host cell of the present disclosure is genetically modified with one or more heterologous nucleic acids encoding a THCAS polypeptide. In some embodiments, a genetically modified host cell of the present disclosure is genetically modified with one or more heterologous nucleic acids encoding more than one THCAS polypeptide. In some embodiments, a genetically modified host cell of the present disclosure is genetically modified with one or more heterologous nucleic acids encoding more than two THCAS polypeptides. In some embodiments, a genetically modified host cell of the present disclosure is genetically modified with one or more heterologous nucleic acids encoding more than three THCAS polypeptides. In some embodiments, a genetically modified host cell of the present disclosure is genetically modified with one or more heterologous nucleic acids encoding two THCAS polypeptides. In some embodiments, a genetically modified host cell of the present disclosure is genetically modified with one or more heterologous nucleic acids encoding three THCAS polypeptides. In some embodiments, a genetically modified host cell of the present disclosure is genetically modified with one or more heterologous nucleic acids encoding 1, 2, 3, or more THCAS polypeptides. In some embodiments, a genetically modified host cell of the present disclosure is genetically modified with one or more heterologous nucleic acids encoding 1, 2, or 3 THCAS polypeptides.

In some embodiments, the THCAS polypeptide encoded by the one or more heterologous nucleic acids comprises the amino acid sequence set forth in SEQ ID NO:14, SEQ ID NO:86, SEQ ID NO:104, SEQ ID NO:153, or SEQ ID NO:155. In some embodiments, the THCAS polypeptide encoded by the one or more heterologous nucleic acids comprises the amino acid sequence set forth in SEQ ID NO:14, SEQ ID NO:86, SEQ ID NO:104, SEQ ID NO:153, or SEQ ID NO:155, or a conservatively substituted amino acid sequence thereof. In some embodiments, the THCAS polypeptide encoded by the one or more heterologous nucleic acids comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:14, SEQ ID NO:86, SEQ ID NO:104, SEQ ID NO:153, or SEQ ID NO:155.

In some embodiments, the THCAS polypeptide encoded by the one or more heterologous nucleic acids comprises the amino acid sequence set forth in SEQ ID NO:14. In some embodiments, the THCAS polypeptide encoded by the one or more heterologous nucleic acids comprises the amino acid sequence set forth in SEQ ID NO:14, or a conservatively substituted amino acid sequence thereof. In some embodiments, the THCAS polypeptide encoded by the one or more heterologous nucleic acids comprises an amino acid sequence having at least 50%, at least 55%, at least 60%, at least 65%, at least 70%, or at least 75% amino acid sequence identity to SEQ ID NO:14. In some embodiments, the THCAS polypeptide encoded by the one or more heterologous nucleic acids comprises an amino acid sequence having at least 80%, at least 81%, at least 82%, at least 83%, or at least 84% amino acid sequence identity to SEQ ID NO:14. In some embodiments, the THCAS polypeptide encoded by the one or more heterologous nucleic acids comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:14.

In some embodiments, the THCAS polypeptide encoded by the one or more heterologous nucleic acids comprises the amino acid sequence set forth in SEQ ID NO:86. In some embodiments, the THCAS polypeptide encoded by the one or more heterologous nucleic acids comprises the amino acid sequence set forth in SEQ ID NO:86, or a conservatively substituted amino acid sequence thereof. In some embodiments, the THCAS polypeptide encoded by the one or more heterologous nucleic acids comprises an amino acid sequence having at least 50%, at least 55%, at least 60%, at least 65%, at least 70%, or at least 75% amino acid sequence identity to SEQ ID NO:86. In some embodiments, the THCAS polypeptide encoded by the one or more heterologous nucleic acids comprises an amino acid sequence having at least 80%, at least 81%, at least 82%, at least 83%, or at least 84% amino acid sequence identity to SEQ ID NO:86. In some embodiments, the THCAS polypeptide encoded by the one or more heterologous nucleic acids comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:86.

In some embodiments, the THCAS polypeptide encoded by the one or more heterologous nucleic acids comprises the amino acid sequence set forth in SEQ ID NO:155. In some embodiments, the THCAS polypeptide encoded by the one or more heterologous nucleic acids comprises the amino acid sequence set forth in SEQ ID NO:155, or a conservatively substituted amino acid sequence thereof. In some embodiments, the THCAS polypeptide encoded by the one or more heterologous nucleic acids comprises an amino acid sequence having at least 50%, at least 55%, at least 60%, at least 65%, at least 70%, or at least 75% amino acid sequence identity to SEQ ID NO:155. In some embodiments, the THCAS polypeptide encoded by the one or more heterologous nucleic acids comprises an amino acid sequence having at least 80%, at least 81%, at least 82%, at least 83%, or at least 84% amino acid sequence identity to SEQ ID NO:155. In some embodiments, the THCAS polypeptide encoded by the one or more heterologous nucleic acids comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:155.

In some embodiments, the THCAS polypeptide may include a modified THCAS polypeptide with an N-terminal truncation to remove the secretion peptide and localize to cytoplasm. For example, in some embodiments, the THCAS polypeptide lacks N-terminal amino acids 1-28 of the amino acid sequence set forth in SEQ ID NO:14, or a corresponding signal peptide of another THCAS polypeptide.

In some embodiments, the THCAS polypeptide encoded by the one or more heterologous nucleic acids comprises the amino acid sequence set forth in SEQ ID NO:15. In some embodiments, the THCAS polypeptide encoded by the one or more heterologous nucleic acids comprises the amino acid sequence set forth in SEQ ID NO:15, or a conservatively substituted amino acid sequence thereof. In some embodiments, the THCAS polypeptide encoded by the one or more heterologous nucleic acids comprises an amino acid sequence having at least 50%, at least 55%, at least 60%, at least 65%, at least 70%, or at least 75% amino acid sequence identity to SEQ ID NO:15. In some embodiments, the THCAS polypeptide encoded by the one or more heterologous nucleic acids comprises an amino acid sequence having at least 80%, at least 81%, at least 82%, at least 83%, or at least 84% amino acid sequence identity to SEQ ID NO:15.

In some embodiments, the THCAS polypeptide encoded by the one or more heterologous nucleic acids comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:15.

In some embodiments, the THCAS polypeptide encoded by the one or more heterologous nucleic acids comprises the amino acid sequence set forth in SEQ ID NO: 104. In some embodiments, the THCAS polypeptide encoded by the one or more heterologous nucleic acids comprises the amino acid sequence set forth in SEQ ID NO: 104, or a conservatively substituted amino acid sequence thereof. In some embodiments, the THCAS polypeptide encoded by the one or more heterologous nucleic acids comprises an amino acid sequence having at least 50%, at least 55%, at least 60%, at least 65%, at least 70%, or at least 75% amino acid sequence identity to SEQ ID NO:104. In some embodiments, the THCAS polypeptide encoded by the one or more heterologous nucleic acids comprises an amino acid sequence having at least 80%, at least 81%, at least 82%, at least 83%, or at least 84% amino acid sequence identity to SEQ ID NO:104. In some embodiments, the THCAS polypeptide encoded by the one or more heterologous nucleic acids comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:104.

In some embodiments, the THCAS polypeptide encoded by the one or more heterologous nucleic acids comprises the amino acid sequence set forth in SEQ ID NO: 153. In some embodiments, the THCAS polypeptide encoded by the one or more heterologous nucleic acids comprises the amino acid sequence set forth in SEQ ID NO: 153, or a conservatively substituted amino acid sequence thereof. In some embodiments, the THCAS polypeptide encoded by the one or more heterologous nucleic acids comprises an amino acid sequence having at least 50%, at least 55%, at least 60%, at least 65%, at least 70%, or at least 75% amino acid sequence identity to SEQ ID NO:153. In some embodiments, the THCAS polypeptide encoded by the one or more heterologous nucleic acids comprises an amino acid sequence having at least 80%, at least 81%, at least 82%, at least 83%, or at least 84% amino acid sequence identity to SEQ ID NO:153. In some embodiments, the THCAS polypeptide encoded by the one or more heterologous nucleic acids comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:153.

Exemplary THCAS heterologous nucleic acids disclosed herein may include nucleic acids that encode a THCAS polypeptide, such as, a fragment of a THCAS polypeptide, a variant of a THCAS polypeptide, a full-length THCAS polypeptide, a truncated THCAS polypeptide, or a fusion polypeptide that has at least one activity of a THCAS polypeptide.

In some embodiments, the THCAS polypeptide is overexpressed in the genetically modified host cell. Overexpression may be achieved by increasing the copy number of the THCAS polypeptide-encoding heterologous nucleic acid, e.g., through use of a high copy number expression vector (e.g., a plasmid that exists at 10-40 copies per cell) and/or by operably linking the THCAS polypeptide-encoding heterologous nucleic acid to a strong promoter. In some embodiments, the genetically modified host cell has one copy of a THCAS polypeptide-encoding heterologous nucleic acid. In some embodiments, the genetically modified host cell has two copies of a THCAS polypeptide-encoding heterologous nucleic acid. In some embodiments, the genetically modified host cell has three copies of a THCAS polypeptide-encoding heterologous nucleic acid. In some embodiments, the genetically modified host cell has four copies of a THCAS polypeptide-encoding heterologous nucleic acid. In some embodiments, the genetically modified host cell has five copies of a THCAS polypeptide-encoding heterologous nucleic acid. In some embodiments, the genetically modified host cell has six copies of a THCAS polypeptide-encoding heterologous nucleic acid. In some embodiments, the genetically modified host cell has seven copies of a THCAS polypeptide-encoding heterologous nucleic acid. In some embodiments, the genetically modified host cell has eight copies of a THCAS polypeptide-encoding heterologous nucleic acid.

In some embodiments, the one or more heterologous nucleic acids encoding a THCAS polypeptide comprise the nucleotide sequence set forth in SEQ ID NO:85, SEQ ID NO:154, or SEQ ID NO:156. In some embodiments, the one or more heterologous nucleic acids encoding a THCAS polypeptide comprise the nucleotide sequence set forth in SEQ ID NO:85, SEQ ID NO:154, or SEQ ID NO:156, or a codon degenerate nucleotide sequence thereof. In some embodiments, the one or more heterologous nucleic acids encoding a THCAS polypeptide comprise a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:85, SEQ ID NO:154, or SEQ ID NO:156.

In some embodiments, the one or more heterologous nucleic acids encoding a THCAS polypeptide comprise the nucleotide sequence set forth in SEQ ID NO:85. In some embodiments, the one or more heterologous nucleic acids encoding a THCAS polypeptide comprise the nucleotide sequence set forth in SEQ ID NO:85, or a codon degenerate nucleotide sequence thereof. In some embodiments, the one or more heterologous nucleic acids encoding a THCAS polypeptide comprise a nucleotide sequence having at least 80%, at least 81%, at least 82%, at least 83%, or at least 84% sequence identity to SEQ ID NO:85. In some embodiments, the one or more heterologous nucleic acids encoding a THCAS polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:85.

In some embodiments, the one or more heterologous nucleic acids encoding a THCAS polypeptide comprise the nucleotide sequence set forth in SEQ ID NO:154. In some embodiments, the one or more heterologous nucleic acids encoding a THCAS polypeptide comprise the nucleotide sequence set forth in SEQ ID NO:154, or a codon degenerate nucleotide sequence thereof. In some embodiments, the one or more heterologous nucleic acids encoding a THCAS polypeptide comprise a nucleotide sequence having at least 80%, at least 81%, at least 82%, at least 83%, or at least 84% sequence identity to SEQ ID NO:154. In some embodiments, the one or more heterologous nucleic acids encoding a THCAS polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:154.

In some embodiments, the one or more heterologous nucleic acids encoding a THCAS polypeptide comprise the nucleotide sequence set forth in SEQ ID NO:156. In some embodiments, the one or more heterologous nucleic acids encoding a THCAS polypeptide comprise the nucleotide sequence set forth in SEQ ID NO:156, or a codon degenerate nucleotide sequence thereof. In some embodiments, the one or more heterologous nucleic acids encoding a THCAS polypeptide comprise a nucleotide sequence having at least 80%, at least 81%, at least 82%, at least 83%, or at least 84% sequence identity to SEQ ID NO:156. In some embodiments, the one or more heterologous nucleic acids encoding a THCAS polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:156.

In some embodiments, a cannabinoid synthase polypeptide is cannabidiolic acid synthase (CBDAS) polypeptide. CBDAS polypeptides can catalyze the conversion of cannabigerolic acid to cannabidiolic acid (CBDA). Exemplary CBDAS polypeptides disclosed herein may include a full-length CBDAS polypeptide, a fragment of a CBDAS polypeptide, a variant of a CBDAS polypeptide, a truncated CBDAS polypeptide, or a fusion polypeptide that has at least one activity of a CBDAS polypeptide.

In some embodiments, a genetically modified host cell of the present disclosure is genetically modified with one or more heterologous nucleic acids encoding a CBDAS polypeptide. In some embodiments, a genetically modified host cell of the present disclosure is genetically modified with one or more heterologous nucleic acids encoding more than one CBDAS polypeptide. In some embodiments, a genetically modified host cell of the present disclosure is genetically modified with one or more heterologous nucleic acids encoding more than two CBDAS polypeptides. In some embodiments, a genetically modified host cell of the present disclosure is genetically modified with one or more heterologous nucleic acids encoding more than three CBDAS polypeptides. In some embodiments, a genetically modified host cell of the present disclosure is genetically modified with one or more heterologous nucleic acids encoding two CBDAS polypeptides. In some embodiments, a genetically modified host cell of the present disclosure is genetically modified with one or more heterologous nucleic acids encoding three CBDAS polypeptides. In some embodiments, a genetically modified host cell of the present disclosure is genetically modified with one or more heterologous nucleic acids encoding 1, 2, 3, or more CBDAS polypeptides. In some embodiments, a genetically modified host cell of the present disclosure is genetically modified with one or more heterologous nucleic acids encoding 1, 2, or 3 CBDAS polypeptides.

In some embodiments, the CBDAS polypeptide encoded by the one or more heterologous nucleic acids comprises the amino acid sequence set forth in SEQ ID NO:88 or SEQ ID NO:151. In some embodiments, the CBDAS polypeptide encoded by the one or more heterologous nucleic acids comprises the amino acid sequence set forth in SEQ ID NO:88 or SEQ ID NO:151, or a conservatively substituted amino acid sequence thereof. In some embodiments, the CBDAS polypeptide encoded by the one or more heterologous nucleic acids comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:88 or SEQ ID NO:151.

In some embodiments, the CBDAS polypeptide encoded by the one or more heterologous nucleic acids comprises the amino acid sequence set forth in SEQ ID NO:88. In some embodiments, the CBDAS polypeptide encoded by the one or more heterologous nucleic acids comprises the amino acid sequence set forth in SEQ ID NO:88, or a conservatively substituted amino acid sequence thereof. In some embodiments, the CBDAS polypeptide encoded by the one or more heterologous nucleic acids comprises an amino acid sequence having at least 50%, at least 55%, at least 60%, at least 65%, at least 70%, or at least 75% amino acid sequence identity to SEQ ID NO:88. In some embodiments, the CBDAS polypeptide encoded by the one or more heterologous nucleic acids comprises an amino acid sequence having at least 80%, at least 81%, at least 82%, at least 83%, or at least 84% amino acid sequence identity to SEQ ID NO:88. In some embodiments, the CBDAS polypeptide encoded by the one or more heterologous nucleic acids comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:88.

In some embodiments, the CBDAS polypeptide may include a modified CBDAS polypeptide with an N-terminal truncation to remove the secretion peptide and localize to cytoplasm. For example, in some embodiments, the CBDAS polypeptide lacks N-terminal amino acids 1-28 of the amino acid sequence set forth in SEQ ID NO:88, or a corresponding signal peptide of another CBDAS polypeptide.

In some embodiments, the CBDAS polypeptide encoded by the one or more heterologous nucleic acids comprises the amino acid sequence set forth in SEQ ID NO:16. In some embodiments, the CBDAS polypeptide encoded by the one or more heterologous nucleic acids comprises the amino acid sequence set forth in SEQ ID NO:16, or a conservatively substituted amino acid sequence thereof. In some embodiments, the CBDAS polypeptide encoded by the one or more heterologous nucleic acids comprises an amino acid sequence having at least 50%, at least 55%, at least 60%, at least 65%, at least 70%, or at least 75% amino acid sequence identity to SEQ ID NO:16. In some embodiments, the CBDAS polypeptide encoded by the one or more heterologous nucleic acids comprises an amino acid sequence having at least 80%, at least 81%, at least 82%, at least 83%, or at least 84% amino acid sequence identity to SEQ ID NO:16. In some embodiments, the CBDAS polypeptide encoded by the one or more heterologous nucleic acids comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:16.

In some embodiments, the CBDAS polypeptide encoded by the one or more heterologous nucleic acids comprises the amino acid sequence set forth in SEQ ID NO:105. In some embodiments, the CBDAS polypeptide encoded by the one or more heterologous nucleic acids comprises the amino acid sequence set forth in SEQ ID NO:105, or a conservatively substituted amino acid sequence thereof. In some embodiments, the CBDAS polypeptide encoded by the one or more heterologous nucleic acids comprises an amino acid sequence having at least 50%, at least 55%, at least 60%, at least 65%, at least 70%, or at least 75% amino acid sequence identity to SEQ ID NO:105. In some embodiments, the CBDAS polypeptide encoded by the one or more heterologous nucleic acids comprises an amino acid sequence having at least 80%, at least 81%, at least 82%, at least 83%, or at least 84% amino acid sequence identity to SEQ ID NO:105. In some embodiments, the CBDAS polypeptide encoded by the one or more heterologous nucleic acids comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:105.

In some embodiments, the CBDAS polypeptide encoded by the one or more heterologous nucleic acids comprises the amino acid sequence set forth in SEQ ID NO:151. In some embodiments, the CBDAS polypeptide encoded by the one or more heterologous nucleic acids comprises the amino acid sequence set forth in SEQ ID NO:151, or a conservatively substituted amino acid sequence thereof. In some embodiments, the CBDAS polypeptide encoded by the one or more heterologous nucleic acids comprises an amino acid sequence having at least 50%, at least 55%, at least 60%, at least 65%, at least 70%, or at least 75% amino acid sequence identity to SEQ ID NO:151. In some embodiments, the CBDAS polypeptide encoded by the one or more heterologous nucleic acids comprises an amino acid sequence having at least 80%, at least 81%, at least 82%, at least 83%, or at least 84% amino acid sequence identity to SEQ ID NO:151. In some embodiments, the CBDAS polypeptide encoded by the one or more heterologous nucleic acids comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:151.

Exemplary CBDAS heterologous nucleic acids disclosed herein may include nucleic acids that encode a CBDAS polypeptide, such as, a full-length CBDAS polypeptide, a fragment of a CBDAS polypeptide, a variant of a CBDAS polypeptide, a truncated CBDAS polypeptide, or a fusion polypeptide that has at least one activity of a CBDAS polypeptide.

In some embodiments, the CBDAS polypeptide is overexpressed in the genetically modified host cell. Overexpression may be achieved by increasing the copy number of the CBDAS polypeptide-encoding heterologous nucleic acid, e.g., through use of a high copy number expression vector (e.g., a plasmid that exists at 10-40 copies per cell) and/or by operably linking the CBDAS polypeptide-encoding heterologous nucleic acid to a strong promoter. In some embodiments, the genetically modified host cell has one copy of a CBDAS polypeptide-encoding heterologous nucleic acid. In some embodiments, the genetically modified host cell has two copies of a CBDAS polypeptide-encoding heterologous nucleic acid. In some embodiments, the genetically modified host cell has three copies of a CBDAS polypeptide-encoding heterologous nucleic acid. In some embodiments, the genetically modified host cell has four copies of a CBDAS polypeptide-encoding heterologous nucleic acid. In some embodiments, the genetically modified host cell has five copies of a CBDAS polypeptide-encoding heterologous nucleic acid. In some embodiments, the genetically modified host cell has six copies of a CBDAS polypeptide-encoding heterologous nucleic acid. In some embodiments, the genetically modified host cell has seven copies of a CBDAS polypeptide-encoding heterologous nucleic acid. In some embodiments, the genetically modified host cell has eight copies of a CBDAS polypeptide-encoding heterologous nucleic acid.

In some embodiments, the one or more heterologous nucleic acids encoding a CBDAS polypeptide comprise the nucleotide sequence set forth in SEQ ID NO:152 or SEQ ID NO:167. In some embodiments, the one or more heterologous nucleic acids encoding a CBDAS polypeptide comprise the nucleotide sequence set forth in SEQ ID NO:152 or SEQ ID NO:167, or a codon degenerate nucleotide sequence thereof. In some embodiments, the one or more heterologous nucleic acids encoding a CBDAS polypeptide comprise a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:152 or SEQ ID NO:167.

In some embodiments, the one or more heterologous nucleic acids encoding a CBDAS polypeptide comprise the nucleotide sequence set forth in SEQ ID NO:87. In some embodiments, the one or more heterologous nucleic acids encoding a CBDAS polypeptide comprise the nucleotide sequence set forth in SEQ ID NO:87, or a codon degenerate nucleotide sequence thereof. In some embodiments, the one or more heterologous nucleic acids encoding a CBDAS polypeptide comprise a nucleotide sequence having at least 80%, at least 81%, at least 82%, at least 83%, or at least 84% sequence identity to SEQ ID NO:87. In some embodiments, the one or more heterologous nucleic acids encoding a CBDAS polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:87.

In some embodiments, the one or more heterologous nucleic acids encoding a CBDAS polypeptide comprise the nucleotide sequence set forth in SEQ ID NO:152. In some embodiments, the one or more heterologous nucleic acids encoding a CBDAS polypeptide comprise the nucleotide sequence set forth in SEQ ID NO:152, or a codon degenerate nucleotide sequence thereof. In some embodiments, the one or more heterologous nucleic acids encoding a CBDAS polypeptide comprise a nucleotide sequence having at least 80%, at least 81%, at least 82%, at least 83%, or at least 84% sequence identity to SEQ ID NO:152. In some embodiments, the one or more heterologous nucleic acids encoding a CBDAS polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:152.

In some embodiments, the one or more heterologous nucleic acids encoding a CBDAS polypeptide comprise the nucleotide sequence set forth in SEQ ID NO:167. In some embodiments, the one or more heterologous nucleic acids encoding a CBDAS polypeptide comprise the nucleotide sequence set forth in SEQ ID NO:167, or a codon degenerate nucleotide sequence thereof. In some embodiments, the one or more heterologous nucleic acids encoding a CBDAS polypeptide comprise a nucleotide sequence having at least 80%, at least 81%, at least 82%, at least 83%, or at least 84% sequence identity to SEQ ID NO:167. In some embodiments, the one or more heterologous nucleic acids encoding a CBDAS polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:167.

In some embodiments, at least one of the heterologous nucleic acids encoding a cannabinoid synthase polypeptide is operably linked to an inducible promoter. In some embodiments, at least one of the heterologous nucleic acids encoding a cannabinoid synthase polypeptide is operably linked to a constitutive promoter. In some embodiments, a signal peptide is linked to the N-terminus of a THCAS or CBDAS polypeptide or other cannabinoid synthase polypeptide.

Polypeptides that Generate Acyl-CoA Compounds or Acyl-CoA Compound Derivatives, Nucleic Acids Comprising Said Polypeptides, and Genetically Modified Host Cells Expressing Said Polypeptides In some embodiments, a genetically modified host cell of the present disclosure is genetically modified with one or more heterologous nucleic acids encoding a polypeptide that generates acyl-CoA compounds or acyl-CoA compound derivatives. Such polypeptides may include, but are not limited to, acyl-activating enzyme (AAE) polypeptides, fatty acyl-CoA synthetases (FAA) polypeptides, or fatty acyl-CoA ligase polypeptides.

In some embodiments, a genetically modified host cell of the present disclosure is genetically modified with one or more heterologous nucleic acids encoding an AAE, FAA, or fatty acyl-CoA ligase polypeptide. In some embodiments, a genetically modified host cell of the present disclosure is genetically modified with one or more heterologous nucleic acids encoding more than one AAE, FAA, or fatty acyl-CoA ligase polypeptide. In some embodiments, a genetically modified host cell of the present disclosure is genetically modified with one or more heterologous nucleic acids encoding more than two AAE, FAA, or fatty acyl-CoA ligase polypeptides. In some embodiments, a genetically modified host cell of the present disclosure is genetically modified with one or more heterologous nucleic acids encoding more than three AAE, FAA, or fatty acyl-CoA ligase polypeptides. In some embodiments, a genetically modified host cell of the present disclosure is genetically modified with one or more heterologous nucleic acids encoding two AAE, FAA, or fatty acyl-CoA ligase polypeptides. In some embodiments, a genetically modified host cell of the present disclosure is genetically modified with one or more heterologous nucleic acids encoding three AAE, FAA, or fatty acyl-CoA ligase polypeptides. In some embodiments, a genetically modified host cell of the present disclosure is genetically modified with one or more heterologous nucleic acids encoding 1, 2, 3, or more AAE, FAA, or fatty acyl-CoA ligase polypeptides. In some embodiments, a genetically modified host cell of the present disclosure is genetically modified with one or more heterologous nucleic acids encoding 1, 2, or 3 AAE, FAA, or fatty acyl-CoA ligase polypeptides.

AAE polypeptides, FAA polypeptides, and fatty acyl-CoA ligase polypeptides can convert carboxylic acids to their CoA forms and generate acyl-CoA compounds or acyl-CoA compound derivatives. Promiscuous acyl-activating enzyme polypeptides, such as CsAAE1 and CsAAE3, FAA polypeptides, or fatty acyl-CoA ligase polypeptides, may permit generation of cannabinoid derivatives (e.g., cannabigerolic acid derivatives) or cannabinoid precursor derivatives (e.g., olivetolic acid derivatives), as well as cannabinoids (e.g., cannabigerolic acid) or precursors thereof (e.g., olivetolic acid). In some embodiments, hexanoic acid or carboxylic acids other than hexanoic acid are fed to genetically modified host cells expressing an AAE polypeptide, FAA polypeptide, or fatty acyl-CoA ligase polypeptide (e.g., are present in the culture medium in which the cells are grown) to generate hexanoyl-CoA, acyl-CoA compounds, derivatives of hexanoyl-CoA, or derivatives of acyl-CoA compounds. In certain such embodiments, the cell culture medium comprising the genetically modified host cells comprises hexanoate. In some embodiments, the cell culture medium comprising the genetically modified host cells comprises a carboxylic acid other than hexanoate.

Exemplary AAE, FAA, or fatty acyl-CoA ligase polypeptides disclosed herein may include a full-length AAE, FAA, or fatty acyl-CoA ligase polypeptide; a fragment of a AAE, FAA, or fatty acyl-CoA ligase polypeptide; a variant of a AAE, FAA, or fatty acyl-CoA ligase polypeptide; a truncated AAE, FAA, or fatty acyl-CoA ligase polypeptide; or a fusion polypeptide that has at least one activity of an AAE, FAA, or fatty acyl-CoA ligase polypeptide.

In some embodiments, the AAE polypeptide encoded by the one or more heterologous nucleic acids is a CsAAE1 polypeptide and comprises the amino acid sequence set forth in SEQ ID NO:90. In some embodiments, the AAE polypeptide encoded by the one or more heterologous nucleic acids is a CsAAE1 polypeptide and comprises the amino acid sequence set forth in SEQ ID NO:90, or a conservatively substituted amino acid sequence thereof. In some embodiments, the AAE polypeptide encoded by the one or more heterologous nucleic acids is a CsAAE1 polypeptide and comprises an amino acid sequence having at least 50%, at least 55%, at least 60%, at least 65%, at least 70%, or at least 75% amino acid sequence identity to SEQ ID NO:90. In some embodiments, the AAE polypeptide encoded by the one or more heterologous nucleic acids is a CsAAE1 polypeptide and comprises an amino acid sequence having at least 80%, at least 81%, at least 82%, at least 83%, or at least 84% amino acid sequence identity to SEQ ID NO:90. In some embodiments, the AAE polypeptide encoded by the one or more heterologous nucleic acids is a CsAAE1 polypeptide and comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:90. In some embodiments, the AAE polypeptide encoded by the one or more heterologous nucleic acids is a CsAAE1 polypeptide and comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:90.

In some embodiments, the AAE polypeptide encoded by the one or more heterologous nucleic acids is a CsAAE3 polypeptide and comprises the amino acid sequence set forth in SEQ ID NO:92 or SEQ ID NO:149. In some embodiments, the AAE polypeptide encoded by the one or more heterologous nucleic acids is a CsAAE3 polypeptide and comprises the amino acid sequence set forth in SEQ ID NO:92 or SEQ ID NO:149, or a conservatively substituted amino acid sequence thereof. In some embodiments, the AAE polypeptide encoded by the one or more heterologous nucleic acids is a CsAAE3 polypeptide and comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:92 or SEQ ID NO:149.

In some embodiments, the AAE polypeptide encoded by the one or more heterologous nucleic acids is a CsAAE3 polypeptide and comprises the amino acid sequence set forth in SEQ ID NO:92. In some embodiments, the AAE polypeptide encoded by the one or more heterologous nucleic acids is a CsAAE3 polypeptide and comprises the amino acid sequence set forth in SEQ ID NO:92, or a conservatively substituted amino acid sequence thereof. In some embodiments, the AAE polypeptide encoded by the one or more heterologous nucleic acids is a CsAAE3 polypeptide and comprises an amino acid sequence having at least 50%, at least 55%, at least 60%, at least 65%, at least 70%, or at least 75% amino acid sequence identity to SEQ ID NO:92. In some embodiments, the AAE polypeptide encoded by the one or more heterologous nucleic acids is a CsAAE3 polypeptide and comprises an amino acid sequence having at least 80%, at least 81%, at least 82%, at least 83%, or at least 84% amino acid sequence identity to SEQ ID NO:92. In some embodiments, the AAE polypeptide encoded by the one or more heterologous nucleic acids is a CsAAE3 polypeptide and comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:92.

In some embodiments, the AAE polypeptide encoded by the one or more heterologous nucleic acids is a CsAAE3 polypeptide and comprises the amino acid sequence set forth in SEQ ID NO:112. In some embodiments, the AAE polypeptide encoded by the one or more heterologous nucleic acids is a CsAAE3 polypeptide and comprises the amino acid sequence set forth in SEQ ID NO:112, or a conservatively substituted amino acid sequence thereof. In some embodiments, the AAE polypeptide encoded by the one or more heterologous nucleic acids is a CsAAE3 polypeptide and comprises an amino acid sequence having at least 50%, at least 55%, at least 60%, at least 65%, at least 70%, or at least 75% amino acid sequence identity to SEQ ID NO:112. In some embodiments, the AAE polypeptide encoded by the one or more heterologous nucleic acids is a CsAAE3 polypeptide and comprises an amino acid sequence having at least 80%, at least 81%, at least 82%, at least 83%, or at least 84% amino acid sequence identity to SEQ ID NO:112. In some embodiments, the AAE polypeptide encoded by the one or more heterologous nucleic acids is a CsAAE3 polypeptide and comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:112. In these proceeding embodiments, the CsAAE3 polypeptide lacks the RELIQKVRSNM C-terminal amino acids.

In some embodiments, the AAE polypeptide encoded by the one or more heterologous nucleic acids is a CsAAE3 polypeptide and comprises the amino acid sequence set forth in SEQ ID NO:149. In some embodiments, the AAE polypeptide encoded by the one or more heterologous nucleic acids is a CsAAE3 polypeptide and comprises the amino acid sequence set forth in SEQ ID NO:149, or a conservatively substituted amino acid sequence thereof. In some embodiments, the AAE polypeptide encoded by the one or more heterologous nucleic acids is a CsAAE3 polypeptide and comprises an amino acid sequence having at least 50%, at least 55%, at least 60%, at least 65%, at least 70%, or at least 75% amino acid sequence identity to SEQ ID NO:149. In some embodiments, the AAE polypeptide encoded by the one or more heterologous nucleic acids is a CsAAE3 polypeptide and comprises an amino acid sequence having at least 80%, at least 81%, at least 82%, at least 83%, or at least 84% amino acid sequence identity to SEQ ID NO:149. In some embodiments, the AAE polypeptide encoded by the one or more heterologous nucleic acids is a CsAAE3 polypeptide and comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:149. In these proceeding embodiments, the CsAAE3 polypeptide lacks the RRELIQKVRSNM C-terminal amino acids.

In some embodiments, the fatty acyl-CoA ligase polypeptide encoded by the one or more heterologous nucleic acids is a FADK polypeptide and comprises the amino acid sequence set forth in SEQ ID NO:145 or SEQ ID NO:147. In some embodiments, the fatty acyl-CoA ligase polypeptide encoded by the one or more heterologous nucleic acids is a FADK polypeptide and comprises the amino acid sequence set forth in SEQ ID NO:145 or SEQ ID NO:147, or a conservatively substituted amino acid sequence thereof. In some embodiments, the fatty acyl-CoA ligase polypeptide encoded by the one or more heterologous nucleic acids is a FADK polypeptide and comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:145 or SEQ ID NO:147.

In some embodiments, the fatty acyl-CoA ligase polypeptide encoded by the one or more heterologous nucleic acids is a FADK polypeptide and comprises the amino acid sequence set forth in SEQ ID NO:145. In some embodiments, the fatty acyl-CoA ligase polypeptide encoded by the one or more heterologous nucleic acids is a FADK polypeptide and comprises the amino acid sequence set forth in SEQ ID NO:145, or a conservatively substituted amino acid sequence thereof. In some embodiments, the fatty acyl-CoA ligase polypeptide encoded by the one or more heterologous nucleic acids is a FADK polypeptide and comprises an amino acid sequence having at least 50%, at least 55%, at least 60%, at least 65%, at least 70%, or at least 75% amino acid sequence identity to SEQ ID NO:145. In some embodiments, the fatty acyl-CoA ligase polypeptide encoded by the one or more heterologous nucleic acids is a FADK polypeptide and comprises an amino acid sequence having at least 80%, at least 81%, at least 82%, at least 83%, or at least 84% amino acid sequence identity to SEQ ID NO:145. In some embodiments, the fatty acyl-CoA ligase polypeptide encoded by the one or more heterologous nucleic acids is a FADK polypeptide and comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:145.

In some embodiments, the fatty acyl-CoA ligase polypeptide encoded by the one or more heterologous nucleic acids is a FADK polypeptide and comprises the amino acid sequence set forth in SEQ ID NO:147. In some embodiments, the fatty acyl-CoA ligase polypeptide encoded by the one or more heterologous nucleic acids is a FADK polypeptide and comprises the amino acid sequence set forth in SEQ ID NO:147, or a conservatively substituted amino acid sequence thereof. In some embodiments, the fatty acyl-CoA ligase polypeptide encoded by the one or more heterologous nucleic acids is a FADK polypeptide and comprises an amino acid sequence having at least 50%, at least 55%, at least 60%, at least 65%, at least 70%, or at least 75% amino acid sequence identity to SEQ ID NO:147. In some embodiments, the tatty acyl-CoA ligase polypeptide encoded by the one or more heterologous nucleic acids is a FADK polypeptide and comprises an amino acid sequence having at least 80%, at least 81%, at least 82%, at least 83%, or at least 84% amino acid sequence identity to SEQ ID NO:147. In some embodiments, the fatty acyl-CoA ligase polypeptide encoded by the one or more heterologous nucleic acids is a FADK polypeptide and comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:147.

In some embodiments, the FAA polypeptide encoded by the one or more heterologous nucleic acids comprises the amino acid sequence set forth in SEQ ID NO:169, SEQ ID NO:192, SEQ ID NO:194, SEQ ID NO:196, SEQ ID NO:198, or SEQ ID NO:200. In some embodiments, the FAA polypeptide encoded by the one or more heterologous nucleic acids comprises the amino acid sequence set forth in SEQ ID NO:169, SEQ ID NO:192, SEQ ID NO:194, SEQ ID NO:196, SEQ ID NO:198, or SEQ ID NO:200, or a conservatively substituted amino acid sequence thereof. In some embodiments, the FAA polypeptide encoded by the one or more heterologous nucleic acids comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:169, SEQ ID NO:192, SEQ ID NO:194, SEQ ID NO:196, SEQ ID NO:198, or SEQ ID NO:200.

In some embodiments, the FAA polypeptide encoded by the one or more heterologous nucleic acids is a FAA2 polypeptide and comprises the amino acid sequence set forth in SEQ ID NO:169. In some embodiments, the FAA polypeptide encoded by the one or more heterologous nucleic acids is a FAA2 polypeptide and comprises the amino acid sequence set forth in SEQ ID NO:169, or a conservatively substituted amino acid sequence thereof. In some embodiments, the FAA polypeptide encoded by the one or more heterologous nucleic acids is a FAA2 polypeptide and comprises an amino acid sequence having at least 50%, at least 55%, at least 60%, at least 65%, at least 70%, or at least 75% amino acid sequence identity to SEQ ID NO:169. In some embodiments, the FAA polypeptide encoded by the one or more heterologous nucleic acids is a FAA2 polypeptide and comprises an amino acid sequence having at least 80%, at least 81%, at least 82%, at least 83%, or at least 84% amino acid sequence identity to SEQ ID NO:169. In some embodiments, the FAA polypeptide encoded by the one or more heterologous nucleic acids is a FAA2 polypeptide and comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:169. In some embodiments, the FAA polypeptide encoded by the one or more heterologous nucleic acids is a FAA2 polypeptide and comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:169.

In some embodiments, the FAA polypeptide encoded by the one or more heterologous nucleic acids is a truncated FAA2 (tFAA2) polypeptide. In some embodiments, the FAA polypeptide encoded by the one or more heterologous nucleic acids is a tFAA2 polypeptide and comprises the amino acid sequence set forth in SEQ ID NO:194. In some embodiments, the FAA polypeptide encoded by the one or more heterologous nucleic acids is a tFAA2 polypeptide and comprises the amino acid sequence set forth in SEQ ID NO:194, or a conservatively substituted amino acid sequence thereof. In some embodiments, the FAA polypeptide encoded by the one or more heterologous nucleic acids is a tFAA2 polypeptide and comprises an amino acid sequence having at least 50%, at least 55%, at least 60%, at least 65%, at least 70%, or at least 75% amino acid sequence identity to SEQ ID NO:194. In some embodiments, the FAA polypeptide, encoded by the one or more heterologous nucleic acids is a tFAA2 polypeptide and comprises an amino acid sequence having at least 80%, at least 81%, at least 82%, at least 83%, or at least 84% amino acid sequence identity to SEQ ID NO:194. In some embodiments, the FAA polypeptide encoded by the one or more heterologous nucleic acids is a tFAA2 polypeptide and comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:194. In some embodiments, the FAA polypeptide, encoded by the one or more heterologous nucleic acids is a tFAA2 polypeptide and comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:194.

In some embodiments, the FAA polypeptide encoded by the one or more heterologous nucleic acids is a mutated FAA2 (FAA2mut) polypeptide. In some embodiments, the FAA polypeptide encoded by the one or more heterologous nucleic acids is a FAA2mut polypeptide and comprises the amino acid sequence set forth in SEQ ID NO:196. In some embodiments, the FAA polypeptide encoded by the one or more heterologous nucleic acids is a FAA2mut polypeptide and comprises the amino acid sequence set forth in SEQ ID NO:196, or a conservatively substituted amino acid sequence thereof. In some embodiments, the FAA polypeptide encoded by the one or more heterologous nucleic acids is a FAA2mut polypeptide and comprises an amino acid sequence having at least 50%, at least 55%, at least 60%, at least 65%, at least 70%, or at least 75% amino acid sequence identity to SEQ ID NO:196. In some embodiments, the FAA polypeptide encoded by the one or more heterologous nucleic acids is a FAA2mut polypeptide and comprises an amino acid sequence having at least 80%, at least 81%, at least 82%, at least 83%, or at least 84% amino acid sequence identity to SEQ ID NO:196. In some embodiments, the FAA polypeptide encoded by the one or more heterologous nucleic acids is a FAA2mut polypeptide and comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:196. In some embodiments, the FAA polypeptide encoded by the one or more heterologous nucleic acids is a FAA2mut polypeptide and comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:196.

In some embodiments, the FAA polypeptide encoded by the one or more heterologous nucleic acids is a FAA1 polypeptide and comprises the amino acid sequence set forth in SEQ ID NO:192. In some embodiments, the FAA polypeptide encoded by the one or more heterologous nucleic acids is a FAA1 polypeptide and comprises the amino acid sequence set forth in SEQ ID NO:192, or a conservatively substituted amino acid sequence thereof. In some embodiments, the FAA polypeptide encoded by the one or more heterologous nucleic acids is a FAA1 polypeptide and comprises an amino acid sequence having at least 50%, at least 55%, at least 60%, at least 65%, at least 70%, or at least 75% amino acid sequence identity to SEQ ID NO:192. In some embodiments, the FAA polypeptide encoded by the one or more heterologous nucleic acids is a FAA1 polypeptide and comprises an amino acid sequence having at least 80%, at least 81%, at least 82%, at least 83%, or at least 84% amino acid sequence identity to SEQ ID NO:192. In some embodiments, the FAA polypeptide encoded by the one or more heterologous nucleic acids is a FAA1 polypeptide and comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:192. In some embodiments, the FAA polypeptide encoded by the one or more heterologous nucleic acids is a FAA1 polypeptide and comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:192.

In some embodiments, the FAA polypeptide encoded by the one or more heterologous nucleic acids is a FAA3 polypeptide and comprises the amino acid sequence set forth in SEQ ID NO:198. In some embodiments, the FAA polypeptide encoded by the one or more heterologous nucleic acids is a FAA3 polypeptide and comprises the amino acid sequence set forth in SEQ ID NO:198, or a conservatively substituted amino acid sequence thereof. In some embodiments, the FAA polypeptide encoded by the one or more heterologous nucleic acids is a FAA3 polypeptide and comprises an amino acid sequence having at least 50%, at least 55%, at least 60%, at least 65%, at least 70%, or at least 75% amino acid sequence identity to SEQ ID NO:198. In some embodiments, the FAA polypeptide encoded by the one or more heterologous nucleic acids is a FAA3 polypeptide and comprises an amino acid sequence having at least 80%, at least 81%, at least 82%, at least 83%, or at least 84% amino acid sequence identity to SEQ ID NO:198. In some embodiments, the FAA polypeptide encoded by the one or more heterologous nucleic acids is a FAA3 polypeptide and comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:198. In some embodiments, the FAA polypeptide encoded by the one or more heterologous nucleic acids is a FAA3 polypeptide and comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:198.

In some embodiments, the FAA polypeptide encoded by the one or more heterologous nucleic acids is a FAA4 polypeptide and comprises the amino acid sequence set forth in SEQ ID NO:200. In some embodiments, the FAA polypeptide encoded by the one or more heterologous nucleic acids is a FAA4 polypeptide and comprises the amino acid sequence set forth in SEQ ID NO:200, or a conservatively substituted amino acid sequence thereof. In some embodiments, the FAA polypeptide encoded by the one or more heterologous nucleic acids is a FAA4 polypeptide and comprises an amino acid sequence having at least 50%, at least 55%, at least 60%, at least 65%, at least 70%, or at least 75% amino acid sequence identity to SEQ ID NO:200. In some embodiments, the FAA polypeptide encoded by the one or more heterologous nucleic acids is a FAA4 polypeptide and comprises an amino acid sequence having at least 80%, at least 81%, at least 82%, at least 83%, or at least 84% amino acid sequence identity to SEQ ID NO:200. In some embodiments, the FAA polypeptide encoded by the one or more heterologous nucleic acids is a FAA4 polypeptide and comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:200. In some embodiments, the FAA polypeptide, encoded by the one or more heterologous nucleic acids is a FAA4 polypeptide and comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:200.

Exemplary AAE, FAA, or fatty acyl-CoA ligase heterologous nucleic acids disclosed herein may include nucleic acids that encode an AAE, FAA, or fatty acyl-CoA ligase polypeptide, such as, a full-length AAE, FAA, or fatty acyl-CoA ligase polypeptide; a fragment of a AAE, FAA, or fatty acyl-CoA ligase polypeptide; a variant of a AAE, FAA, or fatty acyl-CoA ligase polypeptide; a truncated AAE, FAA, or fatty acyl-CoA ligase polypeptide; or a fusion polypeptide that has at least one activity of an AAE, FAA, or fatty acyl-CoA ligase polypeptide.

In some embodiments, the AAE, FAA, or fatty acyl-CoA ligase polypeptide is overexpressed in the genetically modified host cell. Overexpression may be achieved by increasing the copy number of the AAE, FAA, or fatty acyl-CoA ligase polypeptide-encoding heterologous nucleic acid, e.g., through use of a high copy number expression vector (e.g., a plasmid that exists at 10-40 copies per cell) and/or by operably linking the AAE, FAA, or fatty acyl-CoA ligase polypeptide-encoding heterologous nucleic acid to a strong promoter. In some embodiments, the genetically modified host cell has one copy of an AAE, FAA, or fatty acyl-CoA ligase polypeptide-encoding heterologous nucleic acid. In some embodiments, the genetically modified host cell has two copies of an AAE, FAA, or fatty acyl-CoA ligase polypeptide-encoding heterologous nucleic acid. In some embodiments, the genetically modified host cell has three copies of an AAE, FAA, or fatty acyl-CoA ligase polypeptide-encoding heterologous nucleic acid. In some embodiments, the genetically modified host cell has four copies of an AAE, FAA, or fatty acyl-CoA ligase polypeptide-encoding heterologous nucleic acid. In some embodiments, the genetically modified host cell has five copies of an AAE, FAA, or fatty acyl-CoA ligase polypeptide-encoding heterologous nucleic acid. In some embodiments, the genetically modified host cell has six copies of an AAE, FAA, or fatty acyl-CoA ligase polypeptide-encoding heterologous nucleic acid. In some embodiments, the genetically modified host cell has seven copies of an AAE, FAA, or fatty acyl-CoA ligase polypeptide-encoding heterologous nucleic acid. In some embodiments, the genetically modified host cell has eight copies of an AAE, FAA, or fatty acyl-CoA ligase polypeptide-encoding heterologous nucleic acid.

In some embodiments, the one or more heterologous nucleic acids encoding a CsAAE1 polypeptide comprise the nucleotide sequence set forth in SEQ ID NO:164 or SEQ ID NO:165. In some embodiments, the one or more heterologous nucleic acids encoding a CsAAE1 polypeptide comprise the nucleotide sequence set forth in SEQ ID NO:164 or SEQ ID NO:165, or a codon degenerate nucleotide sequence thereof. In some embodiments, the one or more heterologous nucleic acids encoding a CsAAE1 polypeptide comprise a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:164 or SEQ ID NO:165.

In some embodiments, the one or more heterologous nucleic acids encoding a CsAAE1 polypeptide comprise the nucleotide sequence set forth in SEQ ID NO:89. In some embodiments, the one or more heterologous nucleic acids encoding a CsAAE1 polypeptide comprise the nucleotide sequence set forth in SEQ ID NO:89, or a codon degenerate nucleotide sequence thereof. In some embodiments, the one or more heterologous nucleic acids encoding a CsAAE1 polypeptide comprise a nucleotide sequence having at least 80%, at least 81%, at least 82%, at least 83%, or at least 84% sequence identity to SEQ ID NO:89. In some embodiments, the one or more heterologous nucleic acids encoding a CsAAE1 polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:89.

In some embodiments, the one or more heterologous nucleic acids encoding a CsAAE1 polypeptide comprise the nucleotide sequence set forth in SEQ ID NO:164. In some embodiments, the one or more heterologous nucleic acids encoding a CsAAE1 polypeptide comprise the nucleotide sequence set forth in SEQ ID NO:164, or a codon degenerate nucleotide sequence thereof. In some embodiments, the one or more heterologous nucleic acids encoding a CsAAE1 polypeptide comprise a nucleotide sequence having at least 80%, at least 81%, at least 82%, at least 83%, or at least 84% sequence identity to SEQ ID NO:164. In some embodiments, the one or more heterologous nucleic acids encoding a CsAAE1 polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:164.

In some embodiments, the one or more heterologous nucleic acids encoding a CsAAE1 polypeptide comprise the nucleotide sequence set forth in SEQ ID NO:165. In some embodiments, the one or more heterologous nucleic acids encoding a CsAAE1 polypeptide comprise the nucleotide sequence set forth in SEQ ID NO:165, or a codon degenerate nucleotide sequence thereof. In some embodiments, the one or more heterologous nucleic acids encoding a CsAAE1 polypeptide comprise a nucleotide sequence having at least 80%, at least 81%, at least 82%, at least 83%, or at least 84% sequence identity to SEQ ID NO:165. In some embodiments, the one or more heterologous nucleic acids encoding a CsAAE1 polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:165.

In some embodiments, the one or more heterologous nucleic acids encoding a CsAAE3 polypeptide comprise the nucleotide sequence set forth in SEQ ID NO:150 or SEQ ID NO:166. In some embodiments, the one or more heterologous nucleic acids encoding a CsAAE3 polypeptide comprise the nucleotide sequence set forth in SEQ ID NO:150 or SEQ ID NO:166, or a codon degenerate nucleotide sequence thereof. In some embodiments, the one or more heterologous nucleic acids encoding a CsAAE3 polypeptide comprise a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO: 150 or SEQ ID NO:166.

In some embodiments, the one or more heterologous nucleic acids encoding a CsAAE3 polypeptide comprise the nucleotide sequence set forth in SEQ ID NO: 91. In some embodiments, the one or more heterologous nucleic acids encoding a CsAAE3 polypeptide comprise the nucleotide sequence set forth in SEQ ID NO: 91, or a codon degenerate nucleotide sequence thereof. In some embodiments, the one or more heterologous nucleic acids encoding a CsAAE3 polypeptide comprise a nucleotide sequence having at least 80%, at least 81%, at least 82%, at least 83%, or at least 84% sequence identity to SEQ ID NO:91. In some embodiments, the one or more heterologous nucleic acids encoding a CsAAE3 polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:91.

In some embodiments, the one or more heterologous nucleic acids encoding a CsAAE3 polypeptide comprise the nucleotide sequence set forth in SEQ ID NO:150. In some embodiments, the one or more heterologous nucleic acids encoding a CsAAE3 polypeptide comprise the nucleotide sequence set forth in SEQ ID NO:150, or a codon degenerate nucleotide sequence thereof. In some embodiments, the one or more heterologous nucleic acids encoding a CsAAE3 polypeptide comprise a nucleotide sequence having at least 80%, at least 81%, at least 82%, at least 83%, or at least 84% sequence identity to SEQ ID NO:150. In some embodiments, the one or more heterologous nucleic acids encoding a CsAAE3 polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:150.

In some embodiments, the one or more heterologous nucleic acids encoding a CsAAE3 polypeptide comprise the nucleotide sequence set forth in SEQ ID NO:166. In some embodiments, the one or more heterologous nucleic acids encoding a CsAAE3 polypeptide comprise the nucleotide sequence set forth in SEQ ID NO:166, or a codon degenerate nucleotide sequence thereof. In some embodiments, the one or more heterologous nucleic acids encoding a CsAAE3 polypeptide comprise a nucleotide sequence having at least 80%, at least 81%, at least 82%, at least 83%, or at least 84% sequence identity to SEQ ID NO:166. In some embodiments, the one or more heterologous nucleic acids encoding a CsAAE3 polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:166.

In some embodiments, the one or more heterologous nucleic acids encoding a FADK polypeptide comprise the nucleotide sequence set forth in SEQ ID NO:146 or SEQ ID NO:148. In some embodiments, the one or more heterologous nucleic acids encoding a FADK polypeptide comprise the nucleotide sequence set forth in SEQ ID NO:146 or SEQ ID NO:148, or a codon degenerate nucleotide sequence thereof. In some embodiments, the one or more heterologous nucleic acids encoding a FADK polypeptide comprise a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:146 or SEQ ID NO:148.

In some embodiments, the one or more heterologous nucleic acids encoding a FADK polypeptide comprise the nucleotide sequence set forth in SEQ ID NO:146. In some embodiments, the one or more heterologous nucleic acids encoding a FADK polypeptide comprise the nucleotide sequence set forth in SEQ ID NO:146, or a codon degenerate nucleotide sequence thereof. In some embodiments, the one or more heterologous nucleic acids encoding a FADK polypeptide comprise a nucleotide sequence having at least 80%, at least 81%, at least 82%, at least 83%, or at least 84% sequence identity to SEQ ID NO:146. In some embodiments, the one or more heterologous nucleic acids encoding a FADK polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:146.

In some embodiments, the one or more heterologous nucleic acids encoding a FADK polypeptide comprise the nucleotide sequence set forth in SEQ ID NO:148. In some embodiments, the one or more heterologous nucleic acids encoding a FADK polypeptide comprise the nucleotide sequence set forth in SEQ ID NO:148, or a codon degenerate nucleotide sequence thereof. In some embodiments, the one or more heterologous nucleic acids encoding a FADK polypeptide comprise a nucleotide sequence having at least 80%, at least 81%, at least 82%, at least 83%, or at least 84% sequence identity to SEQ ID NO:148. In some embodiments, the one or more heterologous nucleic acids encoding a FADK polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:148.

In some embodiments, the one or more heterologous nucleic acids encoding a FAA polypeptide comprise the nucleotide sequence set forth in SEQ ID NO:168, SEQ ID NO:191, SEQ ID NO:193, SEQ ID NO:195, SEQ ID NO:197, or SEQ ID NO:199. In some embodiments, the one or more heterologous nucleic acids encoding a FAA polypeptide comprise the nucleotide sequence set forth in SEQ ID NO:168, SEQ ID NO:191, SEQ ID NO:193, SEQ ID NO:195, SEQ ID NO:197, or SEQ ID NO:199, or a codon degenerate nucleotide sequence thereof. In some embodiments, the one or more heterologous nucleic acids encoding a FAA polypeptide comprise a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:168, SEQ ID NO:191, SEQ ID NO:193, SEQ ID NO:195, SEQ ID NO:197, or SEQ ID NO:199.

In some embodiments, the one or more heterologous nucleic acids encoding a FAA2 polypeptide comprise the nucleotide sequence set forth in SEQ ID NO:168. In some embodiments, the one or more heterologous nucleic acids encoding a FAA2 polypeptide comprise the nucleotide sequence set forth in SEQ ID NO:168, or a codon degenerate nucleotide sequence thereof. In some embodiments, the one or more heterologous nucleic acids encoding a FAA2 polypeptide comprise a nucleotide sequence having at least 80%, at least 81%, at least 82%, at least 83%, or at least 84% sequence identity to SEQ ID NO:168. In some embodiments, the one or more heterologous nucleic acids encoding a FAA2 polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:168. In some embodiments, the one or more heterologous nucleic acids encoding a FAA2 polypeptide comprise a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:168.

In some embodiments, the one or more heterologous nucleic acids encoding a tFAA2 polypeptide comprise the nucleotide sequence set forth in SEQ ID NO:193. In some embodiments, the one or more heterologous nucleic acids encoding a tFAA2 polypeptide comprise the nucleotide sequence set forth in SEQ ID NO:193, or a codon degenerate nucleotide sequence thereof. In some embodiments, the one or more heterologous nucleic acids encoding a tFAA2 polypeptide comprise a nucleotide sequence having at least 80%, at least 81%, at least 82%, at least 83%, or at least 84% sequence identity to SEQ ID NO:193. In some embodiments, the one or more heterologous nucleic acids encoding a tFAA2 polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:193. In some embodiments, the one or more heterologous nucleic acids encoding a tFAA2 polypeptide comprise a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:193.

In some embodiments, the one or more heterologous nucleic acids encoding a FAA2mut polypeptide comprise the nucleotide sequence set forth in SEQ ID NO:195. In some embodiments, the one or more heterologous nucleic acids encoding a FAA2mut polypeptide comprise the nucleotide sequence set forth in SEQ ID NO:195, or a codon degenerate nucleotide sequence thereof. In some embodiments, the one or more heterologous nucleic acids encoding a FAA2mut polypeptide comprise a nucleotide sequence having at least 80%, at least 81%, at least 82%, at least 83%, or at least 84% sequence identity to SEQ ID NO:195. In some embodiments, the one or more heterologous nucleic acids encoding a FAA2mut polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:195. In some embodiments, the one or more heterologous nucleic acids encoding a FAA2mut polypeptide comprise a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:195.

In some embodiments, the one or more heterologous nucleic acids encoding a FAA1 polypeptide comprise the nucleotide sequence set forth in SEQ ID NO:191. In some embodiments, the one or more heterologous nucleic acids encoding a FAA1 polypeptide comprise the nucleotide sequence set forth in SEQ ID NO:191, or a codon degenerate nucleotide sequence thereof. In some embodiments, the one or more heterologous nucleic acids encoding a FAA1 polypeptide comprise a nucleotide sequence having at least 80%, at least 81%, at least 82%, at least 83%, or at least 84% sequence identity to SEQ ID NO:191. In some embodiments, the one or more heterologous nucleic acids encoding a FAA1 polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:191. In some embodiments, the one or more heterologous nucleic acids encoding a FAA1 polypeptide comprise a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:191.

In some embodiments, the one or more heterologous nucleic acids encoding a FAA3 polypeptide comprise the nucleotide sequence set forth in SEQ ID NO:197. In some embodiments, the one or more heterologous nucleic acids encoding a FAA3 polypeptide comprise the nucleotide sequence set forth in SEQ ID NO:197, or a codon degenerate nucleotide sequence thereof. In some embodiments, the one or more heterologous nucleic acids encoding a FAA3 polypeptide comprise a nucleotide sequence having at least 80%, at least 81%, at least 82%, at least 83%, or at least 84% sequence identity to SEQ ID NO:197. In some embodiments, the one or more heterologous nucleic acids encoding a FAA3 polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:197. In some embodiments, the one or more heterologous nucleic acids encoding a FAA3 polypeptide comprise a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:197.

In some embodiments, the one or more heterologous nucleic acids encoding a FAA4 polypeptide comprise the nucleotide sequence set forth in SEQ ID NO:199. In some embodiments, the one or more heterologous nucleic acids encoding a FAA4 polypeptide comprise the nucleotide sequence set forth in SEQ ID NO:199, or a codon degenerate nucleotide sequence thereof. In some embodiments, the one or more heterologous nucleic acids encoding a FAA4 polypeptide comprise a nucleotide sequence having at least 80%, at least 81%, at least 82%, at least 83%, or at least 84% sequence identity to SEQ ID NO:199. In some embodiments, the one or more heterologous nucleic acids encoding a FAA4 polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:199. In some embodiments, the one or more heterologous nucleic acids encoding a FAA4 polypeptide comprise a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:199.

Polypeptides that Generate or Are Part of a Pathway that Generates Hexanoyl-CoA, Hexanoyl-CoA Derivatives, Acyl-CoA Compounds, or Acyl-CoA Compound Derivatives, Nucleic Acids Comprising Said Polypeptides, and Genetically Modified Host Cells Expressing Said Polypeptides In some embodiments, a genetically modified host cell of the present disclosure is genetically modified with one or more heterologous nucleic acids encoding one or more polypeptides that generate or are part of a biosynthetic pathway that generates hexanoyl-CoA, derivatives of hexanoyl-CoA, acyl-CoA compounds, or acyl-CoA compound derivatives.

In some embodiments, a genetically modified host cell of the present disclosure is genetically modified with one or more heterologous nucleic acids encoding more than one polypeptide that generates or are part of a biosynthetic pathway that generates hexanoyl-CoA, derivatives of hexanoyl-CoA, acyl-CoA compounds, or acyl-CoA compound derivatives. In some embodiments, a genetically modified host cell of the present disclosure is genetically modified with one or more heterologous nucleic acids encoding more than two polypeptides that generate or are part of a biosynthetic pathway that generates hexanoyl-CoA, derivatives of hexanoyl-CoA, acyl-CoA compounds, or acyl-CoA compound derivatives. In some embodiments, a genetically modified host cell of the present disclosure is genetically modified with one or more heterologous nucleic acids encoding more than three polypeptides that generate or are part of a biosynthetic pathway that generates hexanoyl-CoA, derivatives of hexanoyl-CoA, acyl-CoA compounds, or acyl-CoA compound derivatives. In some embodiments, a genetically modified host cell of the present disclosure is genetically modified with one or more heterologous nucleic acids encoding more than four polypeptides that generate or are part of a biosynthetic pathway that generates hexanoyl-CoA, derivatives of hexanoyl-CoA, acyl-CoA compounds, or acyl-CoA compound derivatives. In some embodiments, a genetically modified host cell of the present disclosure is genetically modified with one or more heterologous nucleic acids encoding more than five polypeptides that generate or are part of a biosynthetic pathway that generates hexanoyl-CoA, derivatives of hexanoyl-CoA, acyl-CoA compounds, or acyl-CoA compound derivatives. In some embodiments, a genetically modified host cell of the present disclosure is genetically modified with one or more heterologous nucleic acids encoding two polypeptides that generate or are part of a biosynthetic pathway that generates hexanoyl-CoA, derivatives of hexanoyl-CoA, acyl-CoA compounds, or acyl-CoA compound derivatives. In some embodiments, a genetically modified host cell of the present disclosure is genetically modified with one or more heterologous nucleic acids encoding three polypeptides that generate or are part of a biosynthetic pathway that generates hexanoyl-CoA, derivatives of hexanoyl-CoA, acyl-CoA compounds, or acyl-CoA compound derivatives. In some embodiments, a genetically modified host cell of the present disclosure is genetically modified with one or more heterologous nucleic acids encoding four polypeptides that generate or are part of a biosynthetic pathway that generates hexanoyl-CoA, derivatives of hexanoyl-CoA, acyl-CoA compounds, or acyl-CoA compound derivatives. In some embodiments, a genetically modified host cell of the present disclosure is genetically modified with one or more heterologous nucleic acids encoding five polypeptides that generate or are part of a biosynthetic pathway that generates hexanoyl-CoA, derivatives of hexanoyl-CoA, acyl-CoA compounds, or acyl-CoA compound derivatives. In some embodiments, a genetically modified host cell of the present disclosure is genetically modified with one or more heterologous nucleic acids encoding 1, 2, 3, 4, 5 or more polypeptides that generate or are part of a biosynthetic pathway that generates hexanoyl-CoA, derivatives of hexanoyl-CoA, acyl-CoA compounds, or acyl-CoA compound derivatives. In some embodiments, a genetically modified host cell of the present disclosure is genetically modified with one or more heterologous nucleic acids encoding 1, 2, 3, 4, or 5 polypeptides that generate or are part of a biosynthetic pathway that generates hexanoyl-CoA, derivatives of hexanoyl-CoA, acyl-CoA compounds, or acyl-CoA compound derivatives.

Exemplary polypeptides disclosed herein that generate or are part of a biosynthetic pathway that generates hexanoyl-CoA, derivatives of hexanoyl-CoA, acyl-CoA compounds, or acyl-CoA compound derivatives may include a full-length polypeptide that generates or is part of a biosynthetic pathway that generates hexanoyl-CoA, derivatives of hexanoyl-CoA, acyl-CoA compounds, or acyl-CoA compound derivatives; a fragment of a polypeptide that generates or is part of a biosynthetic pathway that generates hexanoyl-CoA, derivatives of hexanoyl-CoA, acyl-CoA compounds, or acyl-CoA compound derivatives; a variant of a polypeptide that generates or is part of a biosynthetic pathway that generates hexanoyl-CoA, derivatives of hexanoyl-CoA, acyl-CoA compounds, or acyl-CoA compound derivatives; a truncated polypeptide that generates or is part of a biosynthetic pathway that generates hexanoyl-CoA, derivatives of hexanoyl-CoA, acyl-CoA compounds, or acyl-CoA compound derivatives; or a fusion polypeptide that has at least one activity of a polypeptide that generates or is part of a biosynthetic pathway that generates hexanoyl-CoA, derivatives of hexanoyl-CoA, acyl-CoA compounds, or acyl-CoA compound derivatives.

In some embodiments, the one or more polypeptides that generate hexanoyl-CoA, derivatives of hexanoyl-CoA, acyl-CoA compounds, or acyl-CoA compound derivatives may include a hexanoyl-CoA synthase (HCS) polypeptide (e.g., as depicted in Box 1a of FIG. 1). In some embodiments, the one or more polypeptides that generate hexanoyl-CoA, derivatives of hexanoyl-CoA, acyl-CoA compounds, or acyl-CoA compound derivatives is an HCS polypeptide and the cell culture medium comprising the genetically modified host cell comprises hexanoate. In some embodiments, the one or more polypeptides that generate hexanoyl-CoA, derivatives of hexanoyl-CoA, acyl-CoA compounds, or acyl-CoA compound derivatives is an HCS polypeptide and the cell culture medium comprising the genetically modified host cell comprises a carboxylic acid other than hexanoate. In some embodiments, hexanoic acid or carboxylic acids other than hexanoic acid are fed to a genetically modified host cell expressing the HCS polypeptide (e.g., are present in the culture medium in which the cells are grown) to generate hexanoyl-CoA, acyl-CoA compounds, derivatives of hexanoyl-CoA, or derivatives of acyl-CoA compounds.

In some embodiments, the HCS polypeptide encoded by the one or more heterologous nucleic acids comprises the amino acid sequence set forth in SEQ ID NO:1. In some embodiments, the HCS polypeptide encoded by the one or more heterologous nucleic acids comprises the amino acid sequence set forth in SEQ ID NO:1, or a conservatively substituted amino acid sequence thereof. In some embodiments, the HCS polypeptide encoded by the one or more heterologous nucleic acids comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:1.

In some embodiments, the HCS polypeptide encoded by the one or more heterologous nucleic acids is a RevS polypeptide and comprises the amino acid sequence set forth in SEQ ID NO:2. In some embodiments, the HCS polypeptide encoded by the one or more heterologous nucleic acids is a RevS polypeptide and comprises the amino acid sequence set forth in SEQ ID NO:2, or a conservatively substituted amino acid sequence thereof. In some embodiments, the HCS polypeptide encoded by the one or more heterologous nucleic acids is a RevS polypeptide and comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:2.

In some embodiments, the HCS polypeptide encoded by the one or more heterologous nucleic acids is an AflA polypeptide and comprises the amino acid sequence set forth in SEQ ID NO:3. In some embodiments, the HCS polypeptide encoded by the one or more heterologous nucleic acids is an AflA polypeptide and comprises the amino acid sequence set forth in SEQ ID NO:3, or a conservatively substituted amino acid sequence thereof. In some embodiments, the HCS polypeptide encoded by the one or more heterologous nucleic acids is an AflA polypeptide and comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:3.

In some embodiments, the HCS polypeptide encoded by the one or more heterologous nucleic acids is an AflB polypeptide and comprises the amino acid sequence set forth in SEQ ID NO:4. In some embodiments, the HCS polypeptide encoded by the one or more heterologous nucleic acids is an AflB polypeptide and comprises the amino acid sequence set forth in SEQ ID NO:4, or a conservatively substituted amino acid sequence thereof. In some embodiments, the HCS polypeptide encoded by the one or more heterologous nucleic acids is an AflB polypeptide and comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:4.

In some embodiments, a genetically modified host cell of the present disclosure is genetically modified with: i) one or more heterologous nucleic acids that encode an AflA polypeptide and ii) one or more heterologous nucleic acids that encode an AflB polypeptide.

In some embodiments, one or more polypeptides that generate hexanoyl-CoA, derivatives of hexanoyl-CoA, acyl-CoA compounds, or acyl-CoA compound derivatives or are part of a biosynthetic pathway that generates hexanoyl-CoA, derivatives of hexanoyl-CoA, acyl-CoA compounds, or acyl-CoA compound derivatives comprise a MCT1 polypeptide, a PaaH1 polypeptide, a Crt polypeptide, a Ter polypeptide, and a BktB polypeptide. See, e.g., Machado et al. (2012) *Metabolic Engineering* 14:504. In some embodiments, the PaaH1 (3-hydroxyacyl-CoA dehydrogenase) polypeptide encoded by the one or more heterologous nucleic acids comprises the amino acid sequence set forth in SEQ ID NO:18 or SEQ ID NO:46. In some embodiments, the PaaH1 polypeptide encoded by the one or more heterologous nucleic acids comprises the amino acid sequence set forth in SEQ ID NO:18 or SEQ ID NO:46, or a conservatively substituted amino acid sequence thereof. In some embodiments, the PaaH1 polypeptide encoded by the one or more heterologous nucleic acids comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:18 or SEQ ID NO:46. In some embodiments, the Crt (crotonase) polypeptide encoded by the one or more heterologous nucleic acids comprises the amino acid sequence set forth in SEQ ID NO:19 or SEQ ID NO:48. In some embodiments, the Crt polypeptide encoded by the one or more heterologous nucleic acids comprises the amino acid sequence set forth in SEQ ID NO:19 or SEQ ID NO:48, or a conservatively substituted amino acid sequence thereof. In some embodiments, the Crt polypeptide encoded by the one or more heterologous nucleic acids comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:19 or SEQ ID NO:48. In some embodiments, the Ter (trans-2-enoyl-CoA reductase) polypeptide encoded by the one or more heterologous nucleic acids comprises the amino acid sequence set forth in SEQ ID NO:20 or SEQ ID NO:50. In some embodiments, the Ter polypeptide encoded by the one or more heterologous nucleic acids comprises the amino acid sequence set forth in SEQ ID NO:20 or SEQ ID NO:50, or a conservatively substituted amino acid sequence thereof. In some embodiments, the Ter polypeptide encoded by the one or more heterologous nucleic acids comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:20 or SEQ ID NO:50. In some embodiments, the BktB (β-ketothiolase) polypeptide encoded by the one or more heterologous nucleic acids comprises the amino acid sequence set forth in SEQ ID NO:21 or SEQ ID NO:44. In some embodiments, the BktB polypeptide encoded by the one or more heterologous nucleic acids comprises the amino acid sequence set forth in SEQ ID NO:21 or SEQ ID NO:44, or a conservatively substituted amino acid sequence thereof. In some embodiments, the BktB polypeptide encoded by the one or more heterologous nucleic acids comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:21 or SEQ ID NO:44.

In some embodiments, the one or more polypeptides that generate hexanoyl-CoA, derivatives of hexanoyl-CoA, acyl-CoA compounds, or acyl-CoA compound derivatives or are part of a biosynthetic pathway that generates hexanoyl-CoA, derivatives of hexanoyl-CoA, acyl-CoA compounds, or acyl-CoA compound derivatives comprise a MCT1 polypeptide, a PhaB polypeptide, a PhaJ polypeptide, a Ter polypeptide, and a BktB polypeptide. In some embodiments, the PhaB (acetoacetyl-CoA reductase) polypeptide encoded by the one or more heterologous nucleic acids comprises the amino acid sequence set forth in SEQ ID NO:94. In some embodiments, the PhaB polypeptide encoded by the one or more heterologous nucleic acids comprises the amino acid sequence set forth in SEQ ID NO:94, or a conservatively substituted amino acid sequence thereof. In some embodiments, the PhaB polypeptide encoded by the one or more heterologous nucleic acids comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:94. In some embodiments, the PhaJ ((R)-specific enoyl-CoA hydratase) polypeptide encoded by the one or more heterologous nucleic acids comprises the amino acid sequence set forth in SEQ ID NO:96. In some embodiments, the PhaJ polypeptide encoded by the one or more heterologous nucleic acids comprises the amino acid sequence set forth in SEQ ID NO:96, or a conservatively substituted amino acid sequence thereof. In some embodiments, the PhaJ polypeptide encoded by the one or more heterologous nucleic acids comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 993%, at least 99.8%, at least 99.9%, or 100% amino acid sequence identity to SEQ ID NO:96. In some embodiments, the Ter (trans-2-enoyl-CoA reductase) and the BktB (β-ketothiolase) polypeptides used are selected from the Ter and BktB polypeptides disclosed herein.

In some embodiments, the one or more polypeptides that generate hexanoyl-CoA, derivatives of hexanoyl-CoA, acyl-CoA compounds, or acyl-CoA compound derivatives or are part of a biosynthetic pathway that generates hexanoyl-CoA, derivatives of hexanoyl-CoA, acyl-CoA compounds, or acyl-CoA compound derivatives comprise a polypeptide that condenses an acetyl-CoA and a malonyl-CoA to generate acetoacetyl-CoA. Polypeptides that condense an acetyl-CoA and a malonyl-CoA to generate acetoacetyl-CoA may include a malonyl CoA-acyl carrier protein transacylase (MCT1) polypeptide. In some embodiments, the MCT1 polypeptide encoded by the one or more heterologous nucleic acids comprises the amino acid sequence set forth in SEQ ID NO:42. In some embodiments, the MCT1 polypeptide encoded by the one or more heterologous nucleic acids comprises the amino acid sequence set forth in SEQ ID NO:42, or a conservatively substituted amino acid sequence thereof. In some embodiments, the MCT1 polypeptide encoded by the one or more heterologous nucleic acids comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:42. In some embodiments, the host cell is genetically modified with one or more heterologous nucleic acids encoding a polypeptide that condense an acetyl-CoA and a malonyl-CoA to generate acetoacetyl-CoA. In certain such embodiments, the polypeptide that condenses an acetyl-CoA and a malonyl-CoA to generate acetoacetyl-CoA is an MCT1 polypeptide.

The one or more polypeptides that generate hexanoyl-CoA, derivatives of hexanoyl-CoA, acyl-CoA compounds, or acyl-CoA compound derivatives may also include a short chain fatty acyl-CoA thioesterase (SCFA-TE) polypeptide (e.g., as depicted in Box 1c of FIG. 1). In some embodiments, the SCFA-TE polypeptide encoded by the one or more heterologous nucleic acids comprises the amino acid sequence set forth in SEQ ID NO:26, SEQ ID NO:27, SEQ ID NO:28, SEQ ID NO:29, SEQ ID NO:30, or SEQ ID NO:31. In some embodiments, the SCFA-TE polypeptide encoded by the one or more heterologous nucleic acids comprises the amino acid sequence set forth in SEQ ID NO:26, SEQ ID NO:27, SEQ ID NO:28, SEQ ID NO:29, SEQ ID NO:30, or SEQ ID NO:31, or a conservatively substituted amino acid sequence thereof. In some embodiments, the SCFA-TE polypeptide encoded by the one or more heterologous nucleic acids comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:26, SEQ ID NO:27, SEQ ID NO:28, SEQ ID NO:29, SEQ ID NO:30, or SEQ ID NO:31.

In some embodiments, the one or more polypeptides that are part of a biosynthetic pathway that generates hexanoyl-CoA, derivatives of hexanoyl-CoA, acyl-CoA compounds, or acyl-CoA compound derivatives comprise a fatty acid synthase polypeptide, such as a FAS1 or FAS2 polypeptide. In some embodiments, the FAS1 polypeptide encoded by the one or more heterologous nucleic acids is a FAS1 (I306A, R1834K) polypeptide and comprises the amino acid sequence set forth in SEQ ID NO:106. In some embodiments, the FAS1 polypeptide encoded by the one or more heterologous nucleic acids is a FAS1 (I306A, R1834K) polypeptide and comprises the amino acid sequence set forth in SEQ ID NO:106, or a conservatively substituted amino acid sequence thereof. In some embodiments, the FAS1 polypeptide encoded by the one or more heterologous nucleic acids is a FAS1 (I306A, R1834K) polypeptide and comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:106. In some embodiments, the FAS2 polypeptide encoded by the one or more heterologous nucleic acids is a FAS2 (G1250S) polypeptide and comprises the amino acid sequence set forth in SEQ ID NO:107. In some embodiments, the FAS2 polypeptide encoded by the one or more heterologous nucleic acids is a FAS2 (G1250S) polypeptide and comprises the amino acid sequence set forth in SEQ ID NO:107, or a conservatively substituted amino acid sequence thereof. In some embodiments, the FAS2 polypeptide encoded by the one or more heterologous nucleic acids is a FAS2 (G1250S) polypeptide and comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:107.

Exemplary heterologous nucleic acids disclosed herein may include nucleic acids that encode a polypeptide that generates or is part of a biosynthetic pathway that generates hexanoyl-CoA, derivatives of hexanoyl-CoA, acyl-CoA compounds, or acyl-CoA compound derivatives, such as, a full-length polypeptide that generates or is part of a biosynthetic pathway that generates hexanoyl-CoA, derivatives of hexanoyl-CoA, acyl-CoA compounds, or acyl-CoA compound derivatives; a fragment of a polypeptide that generates or is part of a biosynthetic pathway that generates hexanoyl-CoA, derivatives of hexanoyl-CoA, acyl-CoA compounds, or acyl-CoA compound derivatives; a variant of a polypeptide that generates or is part of a biosynthetic pathway that generates hexanoyl-CoA, derivatives of hexanoyl-CoA, acyl-CoA compounds, or acyl-CoA compound derivatives; a truncated polypeptide that generates or is part of a biosynthetic pathway that generates hexanoyl-CoA, derivatives of hexanoyl-CoA, acyl-CoA compounds, or acyl-CoA compound derivatives; or a fusion polypeptide that has at least one activity of a polypeptide that generates or is part of a biosynthetic pathway that generates hexanoyl-CoA, derivatives of hexanoyl-CoA, acyl-CoA compounds, or acyl-CoA compound derivatives.

In some embodiments, the polypeptide that generates or is part of a biosynthetic pathway that generates hexanoyl-CoA, derivatives of hexanoyl-CoA, acyl-CoA compounds, or acyl-CoA compound derivatives is overexpressed in the genetically modified host cell. Overexpression may be achieved by increasing the copy number of the heterologous nucleic acid encoding a polypeptide that generates or is part of a biosynthetic pathway that generates hexanoyl-CoA, derivatives of hexanoyl-CoA, acyl-CoA compounds, or acyl-CoA compound derivatives, e.g., through use of a high copy number expression vector (e.g., a plasmid that exists at 10-40 copies per cell) and/or by operably linking the polypeptide that generates or is part of a biosynthetic pathway that generates hexanoyl-CoA, derivatives of hexanoyl-CoA, acyl-CoA compounds, or acyl-CoA compound derivatives encoding heterologous nucleic acid to a strong promoter. In some embodiments, the genetically modified host cell has one copy of a heterologous nucleic acid encoding a polypeptide that generates or is part of a biosynthetic pathway that generates hexanoyl-CoA, derivatives of hexanoyl-CoA, acyl-CoA compounds, or acyl-CoA compound derivatives. In some embodiments, the genetically modified host cell has two copies of a heterologous nucleic acid encoding a polypeptide that generates or is part of a biosynthetic pathway that generates hexanoyl-CoA, derivatives of hexanoyl-CoA, acyl-CoA compounds, or acyl-CoA compound derivatives. In some embodiments, the genetically modified host cell has three copies of a heterologous nucleic acid encoding a polypeptide that generates or is part of a biosynthetic pathway that generates hexanoyl-CoA, derivatives of hexanoyl-CoA, acyl-CoA compounds, or acyl-CoA compound derivatives. In some embodiments, the genetically modified host cell has four copies of a heterologous nucleic acid encoding a polypeptide that generates or is part of a biosynthetic pathway that generates hexanoyl-CoA, derivatives of hexanoyl-CoA, acyl-CoA compounds, or acyl-CoA compound derivatives. In some embodiments, the genetically modified host cell has five copies of a heterologous nucleic acid encoding a polypeptide that generates or is part of a biosynthetic pathway that generates hexanoyl-CoA, derivatives of hexanoyl-CoA, acyl-CoA compounds, or acyl-CoA compound derivatives.

In some embodiments, the one or more heterologous nucleic acids encoding an MCT1 polypeptide comprise the nucleotide sequence set forth in SEQ ID NO:41. In some embodiments, the one or more heterologous nucleic acids encoding an MCT1 polypeptide comprise the nucleotide sequence set forth in SEQ ID NO:41, or a codon degenerate nucleotide sequence thereof. In some embodiments, the one or more heterologous nucleic acids encoding an MCT1 polypeptide comprise a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:41. In some embodiments, the one or more heterologous nucleic acids encoding a BktB polypeptide comprise the nucleotide sequence set forth in SEQ ID NO:43. In some embodiments, the one or more heterologous nucleic acids encoding a BktB polypeptide comprise the nucleotide sequence set forth in SEQ ID NO:43, or a codon degenerate nucleotide sequence thereof. In some embodiments, the one or more heterologous nucleic acids encoding a BktB polypeptide comprise a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:43. In some embodiments, the one or more heterologous nucleic acids encoding a PaaH1 polypeptide comprise the nucleotide sequence set forth in SEQ ID NO:45. In some embodiments, the one or more heterologous nucleic acids encoding a PaaH1 polypeptide comprise the nucleotide sequence set forth in SEQ ID NO:45, or a codon degenerate nucleotide sequence thereof. In some embodiments, the one or more heterologous nucleic acids encoding a PaaH1 polypeptide comprise a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:45. In some embodiments, the one or more heterologous nucleic acids encoding a Crt polypeptide, comprise the nucleotide sequence set forth in SEQ ID NO:47. In some embodiments, the one or more heterologous nucleic acids encoding a Crt polypeptide comprise the nucleotide sequence set forth in SEQ ID NO:47, or a codon degenerate nucleotide sequence thereof. In some embodiments, the one or more heterologous nucleic acids encoding a Crt polypeptide comprise a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:47. In some embodiments, the one or more heterologous nucleic acids encoding a Ter polypeptide comprise the nucleotide sequence set forth in SEQ ID NO:49. In some embodiments, the one or more heterologous nucleic acids encoding a Ter polypeptide comprise the nucleotide sequence set forth in SEQ ID NO:49, or a codon degenerate nucleotide sequence thereof. In some embodiments, the one or more heterologous nucleic acids encoding a Ter polypeptide comprise a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:49. In some embodiments, the one or more heterologous nucleic acids encoding a PhaB polypeptide comprise the nucleotide sequence set forth in SEQ ID NO:93. In some embodiments, the one or more heterologous nucleic acids encoding a PhaB polypeptide comprise the nucleotide sequence set forth in SEQ ID NO:93, or a codon degenerate nucleotide sequence thereof. In some embodiments, the one or more heterologous nucleic acids encoding a PhaB polypeptide comprise a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:93. In some embodiments, the one or more heterologous nucleic acids encoding a PhaJ polypeptide comprise the nucleotide sequence set forth in SEQ ID NO:95. In some embodiments, the one or more heterologous nucleic acids encoding a PhaJ polypeptide comprise the nucleotide sequence set forth in SEQ ID NO:95, or a codon degenerate nucleotide sequence thereof. In some embodiments, the one or more heterologous nucleic acids encoding a PhaJ polypeptide comprise a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:95.

Polypeptides that Generate Malonyl-CoA, Nucleic Acids Comprising Said Polypeptides, and Genetically Modified Host Cells Expressing Said Polypeptides In some embodiments, the host cell is genetically modified with one or more heterologous nucleic acids encoding a polypeptide that generates malonyl-CoA. In some embodiments, the polypeptide that generates malonyl-CoA is an acetyl-CoA carboxylate (ACC) polypeptide. In some embodiments, a genetically modified host cell of the present disclosure is genetically modified with one or more heterologous nucleic acids encoding an ACC polypeptide.

Exemplary ACC polypeptides disclosed herein may include a full-length ACC polypeptide, a fragment of an ACC polypeptide, a variant of an ACC polypeptide, a truncated ACC polypeptide, or a fusion polypeptide that has at least one activity of an ACC polypeptide.

In some embodiments, the ACC polypeptide encoded by the one or more heterologous nucleic acids comprises the amino acid sequence set forth in SEQ ID NO:9, SEQ ID NO:97, or SEQ ID NO:207. In some embodiments, the ACC polypeptide encoded by the one or more heterologous nucleic acids comprises the amino acid sequence set forth in SEQ ID NO:9, SEQ ID NO:97, or SEQ ID NO:207, or a conservatively substituted amino acid sequence thereof. In some embodiments, the ACC polypeptide encoded by the one or more heterologous nucleic acids comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:9, SEQ ID NO:97, or SEQ ID NO:207.

In some embodiments, the ACC polypeptide encoded by the one or more heterologous nucleic acids is an ACC1 polypeptide and comprises the amino acid sequence set forth in SEQ ID NO:9. In some embodiments, the ACC polypeptide encoded by the one or more heterologous nucleic acids is an ACC1 polypeptide and comprises the amino acid sequence set forth in SEQ ID NO:9, or a conservatively substituted amino acid sequence thereof. In some embodiments, the ACC polypeptide encoded by the one or more heterologous nucleic acids is an ACC1 polypeptide and comprises an amino acid sequence having at least 50%, at least 55%, at least 60%, at least 65%, at least 70%, or at least 75% amino acid sequence identity to SEQ ID NO:9. In some embodiments, the ACC polypeptide encoded by the one or more heterologous nucleic acids is an ACC1 polypeptide and comprises an amino acid sequence having at least 80%, at least 81%, at least 82%, at least 83%, or at least 84% amino acid sequence identity to SEQ ID NO:9. In some embodiments, the ACC polypeptide encoded by the one or more heterologous nucleic acids is an ACC1 polypeptide and comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:9.

In some embodiments, the ACC polypeptide encoded by the one or more heterologous nucleic acids is an ACC1 (S659A, S1157A) polypeptide and comprises the amino acid sequence set forth in SEQ ID NO:97. In some embodiments, the ACC polypeptide encoded by the one or more heterologous nucleic acids is an ACC1 (S659A, S1157A) polypeptide and comprises the amino acid sequence set forth in SEQ ID NO:97, or a conservatively substituted amino acid sequence thereof. In some embodiments, the ACC polypeptide encoded by the one or more heterologous nucleic acids is an ACC1 (S659A, S1157A) polypeptide and comprises an amino acid sequence having at least 50%, at least 55%, at least 60%, at least 65%, at least 70%, or at least 75% amino acid sequence identity to SEQ ID NO:97. In some embodiments, the ACC polypeptide encoded by the one or more heterologous nucleic acids is an ACC1 (S659A, S1157A) polypeptide and comprises an amino acid sequence having at least 80%, at least 81%, at least 82%, at least 83%, or at least 84% amino acid sequence identity to SEQ ID NO:97. In some embodiments, the ACC polypeptide encoded by the one or more heterologous nucleic acids is an ACC1 (S659A, S1157A) polypeptide and comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:97.

In some embodiments, the ACC polypeptide encoded by the one or more heterologous nucleic acids is an ACC1 (S659A, S1157A) polypeptide and comprises the amino acid sequence set forth in SEQ ID NO:207. In some embodiments, the ACC polypeptide encoded by the one or more heterologous nucleic acids is an ACC1 (S659A, S1157A) polypeptide and comprises the amino acid sequence set forth in SEQ ID NO:207, or a conservatively substituted amino acid sequence thereof. In some embodiments, the ACC polypeptide encoded by the one or more heterologous nucleic acids is an ACC1 (S659A, S1157A) polypeptide and comprises an amino acid sequence having at least 50%, at least 55%, at least 60%, at least 65%, at least 70%, or at least 75% amino acid sequence identity to SEQ ID NO:207. In some embodiments, the ACC polypeptide encoded by the one or more heterologous nucleic acids is an ACC1 (S659A, S1157A) polypeptide and comprises an amino acid sequence having at least 80%, at least 81%, at least 82%, at least 83%, or at least 84% amino acid sequence identity to SEQ ID NO:207. In some embodiments, the ACC polypeptide encoded by the one or more heterologous nucleic acids is an ACC1 (S659A, S1157A) polypeptide and comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:207.

Exemplary ACC heterologous nucleic acids disclosed herein may include nucleic acids that encode an ACC polypeptide, such as, a full-length ACC polypeptide, a fragment of an ACC polypeptide, a variant of an ACC polypeptide, a truncated ACC polypeptide, or a fusion polypeptide that has at least one activity of an ACC polypeptide.

In some embodiments, the ACC polypeptide is overexpressed in the genetically modified host cell. See, e.g., Runguphan and Keasling (2014) *Metabolic Engineering* 21:103. Overexpression may be achieved by increasing the copy number of the ACC polypeptide-encoding heterologous nucleic acid, e.g., through use of a high copy number expression vector (e.g., a plasmid that exists at 10-40 copies per cell) and/or by operably linking the ACC polypeptide-encoding heterologous nucleic acid to a strong promoter. In some embodiments, the genetically modified host cell has one copy of an ACC polypeptide-encoding heterologous nucleic acid. In some embodiments, the genetically modified host cell has two copies of an ACC polypeptide-encoding heterologous nucleic acid. In some embodiments, the genetically modified host cell has three copies of an ACC polypeptide-encoding heterologous nucleic acid. In some embodiments, the genetically modified host cell has four copies of an ACC polypeptide-encoding heterologous nucleic acid. In some embodiments, the genetically modified host cell has five copies of an ACC polypeptide-encoding heterologous nucleic acid. In some embodiments, the genetically modified host cell has six copies of an ACC polypeptide-encoding heterologous nucleic acid. In some embodiments, the genetically modified host cell has seven copies of an ACC polypeptide-encoding heterologous nucleic acid. In some embodiments, the genetically modified host cell has eight copies of an ACC polypeptide-encoding heterologous nucleic acid.

In some embodiments, the one or more heterologous nucleic acids encoding an ACC polypeptide comprise the nucleotide sequence set forth in SEQ ID NO:201. In some embodiments, the one or more heterologous nucleic acids encoding an ACC polypeptide comprise the nucleotide sequence set forth in SEQ ID NO:201, or a codon degenerate nucleotide sequence thereof. In some embodiments, the one or more heterologous nucleic acids encoding an ACC polypeptide comprise a nucleotide sequence having at least 80%, at least 81%, at least 82%, at least 83%, or at least 84% sequence identity to SEQ ID NO:201. In some embodiments, the one or more heterologous nucleic acids encoding an ACC polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:201. In some embodiments, the one or more heterologous nucleic acids encoding an ACC polypeptide comprise a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:201.

Polypeptides that Condense an Acyl-CoA Compound or an Acyl-CoA Compound Derivative with Malonyl-CoA to Generate Olivetolic Acid or Derivatives of Olivetolic Acid, Nucleic Acids Comprising Said Polypeptides, and Genetically Modified Host Cells Expressing Said Polypeptides In some embodiments, a genetically modified host cell of the present disclosure is genetically modified with one or more heterologous nucleic acids encoding one or more polypeptides that condense an acyl-CoA compound, such as hexanoyl-CoA, or an acyl-CoA compound derivative, such as a hexanoyl-CoA derivative, with malonyl-CoA to generate olivetolic acid, or a derivative of olivetolic acid. Polypeptides that react an acyl-CoA compound or an acyl-CoA compound derivative with malonyl-CoA to generate olivetolic acid, or a derivative of olivetolic acid, may include TKS and OAC polypeptides. TKS and OAC polypeptides have been found to have broad substrate specificity, enabling production of cannabinoid derivatives or cannabinoid precursor derivatives, in addition to cannabinoids and cannabinoid precursors.

In some embodiments, a genetically modified host cell of the present disclosure is genetically modified with one or more heterologous nucleic acids encoding a TKS polypeptide. In some embodiments, a genetically modified host cell of the present disclosure is genetically modified with one or more heterologous nucleic acids encoding more than one TKS polypeptide. In some embodiments, a genetically modified host cell of the present disclosure is genetically modified with one or more heterologous nucleic acids encoding more than two TKS polypeptides. In some embodiments, a genetically modified host cell of the present disclosure is genetically modified with one or more heterologous nucleic acids encoding more than three TKS polypeptides. In some embodiments, a genetically modified host cell of the present disclosure is genetically modified with one or more heterologous nucleic acids encoding two TKS polypeptides. In some embodiments, a genetically modified host cell of the present disclosure is genetically modified with one or more heterologous nucleic acids encoding three TKS polypeptides. In some embodiments, a genetically modified host cell of the present disclosure is genetically modified with one or more heterologous nucleic acids encoding 1, 2, 3, or more TKS polypeptides. In some embodiments, a genetically modified host cell of the present disclosure is genetically modified with one or more heterologous nucleic acids encoding 1, 2, or 3 TKS polypeptides.

In some embodiments, a genetically modified host cell of the present disclosure is genetically modified with one or more heterologous nucleic acids encoding an OAC polypeptide. In some embodiments, a genetically modified host cell of the present disclosure is genetically modified with one or more heterologous nucleic acids encoding more than one OAC polypeptide. In some embodiments, a genetically modified host cell of the present disclosure is genetically modified with one or more heterologous nucleic acids encoding more than two OAC polypeptides. In some embodiments, a genetically modified host cell of the present disclosure is genetically modified with one or more heterologous nucleic acids encoding more than three OAC polypeptides. In some embodiments, a genetically modified host cell of the present disclosure is genetically modified with one or more heterologous nucleic acids encoding two OAC polypeptides. In some embodiments, a genetically modified host cell of the present disclosure is genetically modified with one or more heterologous nucleic acids encoding three OAC polypeptides. In some embodiments, a genetically modified host cell of the present disclosure is genetically modified with one or more heterologous nucleic acids encoding 1, 2, 3, or more OAC polypeptides. In some embodiments, a genetically modified host cell of the present disclosure is genetically modified with one or more heterologous nucleic acids encoding 1, 2, or 3 OAC polypeptides.

Exemplary TKS or OAC polypeptides disclosed herein may include a full-length TKS or OAC polypeptide, a fragment of a TKS or OAC polypeptide, a variant of a TKS or OAC polypeptide, a truncated TKS or OAC polypeptide, or a fusion polypeptide that has at least one activity of a TKS or OAC polypeptide.

In some embodiments, the TKS polypeptide encoded by the one or more heterologous nucleic acids comprises the amino acid sequence set forth in SEQ ID NO:11 or SEQ ID NO:76. In some embodiments, the TKS polypeptide encoded by the one or more heterologous nucleic acids comprises the amino acid sequence set forth in SEQ ID NO:11 or SEQ ID NO:76, or a conservatively substituted amino acid sequence thereof. In some embodiments, the TKS polypeptide encoded by the one or more heterologous nucleic acids comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:11 or SEQ ID NO:76.

In some embodiments, the OAC polypeptide encoded by the one or more heterologous nucleic acids comprises the amino acid sequence set forth in SEQ ID NO:10 or SEQ ID NO:78. In some embodiments, the OAC polypeptide encoded by the one or more heterologous nucleic acids comprises the amino acid sequence set forth in SEQ ID NO:10 or SEQ ID NO:78, or a conservatively substituted amino acid sequence thereof. In some embodiments, the OAC polypeptide encoded by the one or more heterologous nucleic acids comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:10 or SEQ ID NO:78.

In some embodiments, the TKS polypeptide encoded by the one or more heterologous nucleic acids comprises the amino acid sequence set forth in SEQ ID NO:11. In some embodiments, the TKS polypeptide encoded by the one or more heterologous nucleic acids comprises the amino acid sequence set forth in SEQ ID NO:11, or a conservatively substituted amino acid sequence thereof. In some embodiments, the TKS polypeptide encoded by the one or more heterologous nucleic acids comprises an amino acid sequence having at least 50%, at least 55%, at least 60%, at least 65%, at least 70%, or at least 75% amino acid sequence identity to SEQ ID NO:11. In some embodiments, the TKS polypeptide encoded by the one or more heterologous nucleic acids comprises an amino acid sequence having at least 80%, at least 81%, at least 82%, at least 83%, or at least 84% amino acid sequence identity to SEQ ID NO:11. In some embodiments, the TKS polypeptide encoded by the one or more heterologous nucleic acids comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:11.

In some embodiments, the TKS polypeptide encoded by the one or more heterologous nucleic acids comprises the amino acid sequence set forth in SEQ ID NO:76. In some embodiments, the TKS polypeptide encoded by the one or more heterologous nucleic acids comprises the amino acid sequence set forth in SEQ ID NO:76, or a conservatively substituted amino acid sequence thereof. In some embodiments, the TKS polypeptide encoded by the one or more heterologous nucleic acids comprises an amino acid sequence having at least 50%, at least 55%, at least 60%, at least 65%, at least 70%, or at least 75% amino acid sequence identity to SEQ ID NO:76. In some embodiments, the TKS polypeptide encoded by the one or more heterologous nucleic acids comprises an amino acid sequence having at least 80%, at least 81%, at least 82%, at least 83%, or at least 84% amino acid sequence identity to SEQ ID NO:76. In some embodiments, the TKS polypeptide encoded by the one or more heterologous nucleic acids comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:76.

In some embodiments, the OAC polypeptide encoded by the one or more heterologous nucleic acids comprises the amino acid sequence set forth in SEQ ID NO:10. In some embodiments, the OAC polypeptide encoded by the one or more heterologous nucleic acids comprises the amino acid sequence set forth in SEQ ID NO:10, or a conservatively substituted amino acid sequence thereof. In some embodiments, the OAC polypeptide encoded by the one or more heterologous nucleic acids comprises an amino acid sequence having at least 50%, at least 55%, at least 60%, at least 65%, at least 70%, or at least 75% amino acid sequence identity to SEQ ID NO:10. In some embodiments, the OAC polypeptide encoded by the one or more heterologous nucleic acids comprises an amino acid sequence having at least 80%, at least 81%, at least 82%, at least 83%, or at least 84% amino acid sequence identity to SEQ ID NO:10. In some embodiments, the OAC polypeptide encoded by the one or more heterologous nucleic acids comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:10.

In some embodiments, the OAC polypeptide encoded by the one or more heterologous nucleic acids comprises the amino acid sequence set forth in SEQ ID NO:78. In some embodiments, the OAC polypeptide encoded by the one or more heterologous nucleic acids comprises the amino acid sequence set forth in SEQ ID NO:78, or a conservatively substituted amino acid sequence thereof. In some embodiments, the OAC polypeptide encoded by the one or more heterologous nucleic acids comprises an amino acid sequence having at least 50%, at least 55%, at least 60%, at least 65%, at least 70%, or at least 75% amino acid sequence identity to SEQ ID NO:78. In some embodiments, the OAC polypeptide encoded by the one or more heterologous nucleic acids comprises an amino acid sequence having at least 80%, at least 81%, at least 82%, at least 83%, or at least 84% amino acid sequence identity to SEQ ID NO:78. In some embodiments, the OAC polypeptide encoded by the one or more heterologous nucleic acids comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:78.

In some embodiments, the TKS and OAC polypeptides are fused into a single polypeptide chain (a TKS/OAC fusion polypeptide). In some embodiments, the TKS/OAC polypeptide encoded by the one or more heterologous nucleic acids comprises the amino acid sequence set forth in SEQ ID NO:80. In some embodiments, the TKS/OAC polypeptide encoded by the one or more heterologous nucleic acids comprises the amino acid sequence set forth in SEQ ID NO:80, or a conservatively substituted amino acid sequence thereof. In some embodiments, the TKS/OAC polypeptide encoded by the one or more heterologous nucleic acids comprises an amino acid sequence having at least 50%, at least 55%, at least 60%, at least 65%, at least 70%, or at least 75% amino acid sequence identity to SEQ ID NO:80. In some embodiments, the TKS/OAC polypeptide encoded by the one or more heterologous nucleic acids comprises an amino acid sequence having at least 80%, at least 81%, at least 82%, at least 83%, or at least 84% amino acid sequence identity to SEQ ID NO:80. In some embodiments, the TKS/OAC polypeptide encoded by the one or more heterologous nucleic acids comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:80. In some embodiments, the TKS/OAC polypeptide encoded by the one or more heterologous nucleic acids comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:80.

Exemplary TKS or OAC heterologous nucleic acids disclosed herein may include nucleic acids that encode a TKS or OAC polypeptide, such as, a full-length TKS or OAC polypeptide, a fragment of a TKS or OAC polypeptide, a variant of a TKS or OAC polypeptide, a truncated TKS or OAC polypeptide, or a fusion polypeptide that has at least one activity of a TKS or OAC polypeptide.

In some embodiments, the TKS or OAC polypeptide is overexpressed in the genetically modified host cell. Overexpression may be achieved by increasing the copy number of the TKS and/or OAC polypeptide-encoding heterologous nucleic acid, e.g., through use of a high copy number expression vector (e.g., a plasmid that exists at 10-40 copies per cell) and/or by operably linking the TKS and/or OAC polypeptide-encoding heterologous nucleic acid to a strong promoter. In some embodiments, the genetically modified host cell has one copy of a TKS and/or OAC polypeptide-encoding heterologous nucleic acid. In some embodiments, the genetically modified host cell has two copies of a TKS and/or OAC polypeptide-encoding heterologous nucleic acid. In some embodiments, the genetically modified host cell has three copies of a TKS and/or OAC polypeptide-encoding heterologous nucleic acid. In some embodiments, the genetically modified host cell has four copies of a TKS and/or OAC polypeptide-encoding heterologous nucleic acid. In some embodiments, the genetically modified host cell has five copies of a TKS and/or OAC polypeptide-encoding heterologous nucleic acid. In some embodiments, the genetically modified host cell has six copies of a TKS and/or OAC polypeptide-encoding heterologous nucleic acid. In some embodiments, the genetically modified host cell has seven copies of a TKS and/or OAC polypeptide-encoding heterologous nucleic acid. In some embodiments, the genetically modified host cell has eight copies of a TKS and/or OAC polypeptide-encoding heterologous nucleic acid. In some embodiments, the genetically modified host cell has nine copies of a TKS and/or OAC polypeptide-encoding heterologous nucleic acid. In some embodiments, the genetically modified host cell has 10 copies of a TKS and/or OAC polypeptide-encoding heterologous nucleic acid. In some embodiments, the genetically modified host cell has 11 copies of a TKS and/or OAC polypeptide-encoding heterologous nucleic acid. In some embodiments, the genetically modified host cell has 12 copies of a TKS and/or OAC polypeptide-encoding heterologous nucleic acid.

In some embodiments, the one or more heterologous nucleic acids encoding an OAC polypeptide comprise the nucleotide sequence set forth in SEQ ID NO:77 or SEQ ID NO:163. In some embodiments, the one or more heterologous nucleic acids encoding an OAC polypeptide comprise the nucleotide sequence set forth in SEQ ID NO:77 or SEQ ID NO:163, or a codon degenerate nucleotide sequence thereof. In some embodiments, the one or more heterologous nucleic acids encoding an OAC polypeptide comprise a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:77 or SEQ ID NO:163.

In some embodiments, the one or more heterologous nucleic acids encoding a TKS polypeptide comprise the nucleotide sequence set forth in SEQ ID NO:75. In some embodiments, the one or more heterologous nucleic acids encoding a TKS polypeptide comprise the nucleotide sequence set forth in SEQ ID NO:75, or a codon degenerate nucleotide sequence thereof. In some embodiments, the one or more heterologous nucleic acids encoding a TKS polypeptide comprise a nucleotide sequence having at least 80%, at least 81%, at least 82%, at least 83%, or at least 84% sequence identity to SEQ ID NO:75. In some embodiments, the one or more heterologous nucleic acids encoding a TKS polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:75.

In some embodiments, the one or more heterologous nucleic acids encoding a TKS polypeptide comprise the nucleotide sequence set forth in SEQ ID NO:162. In some embodiments, the one or more heterologous nucleic acids encoding a TKS polypeptide comprise the nucleotide sequence set forth in SEQ ID NO:162, or a codon degenerate nucleotide sequence thereof. In some embodiments, the one or more heterologous nucleic acids encoding a TKS polypeptide comprise a nucleotide sequence having at least 80%, at least 81%, at least 82%, at least 83%, or at least 84% sequence identity to SEQ ID NO:162. In some embodiments, the one or more heterologous nucleic acids encoding a TKS polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:162. In some embodiments, the one or more heterologous nucleic acids encoding a TKS polypeptide comprise a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:162.

In some embodiments, the one or more heterologous nucleic acids encoding an OAC polypeptide comprise the nucleotide sequence set forth in SEQ ID NO:77. In some embodiments, the one or more heterologous nucleic acids encoding an OAC polypeptide comprise the nucleotide sequence set forth in SEQ ID NO:77, or a codon degenerate nucleotide sequence thereof. In some embodiments, the one or more heterologous nucleic acids encoding an OAC polypeptide comprise a nucleotide sequence having at least 80%, at least 81%, at least 82%, at least 83%, or at least 84% sequence identity to SEQ ID NO:77. In some embodiments, the one or more heterologous nucleic acids encoding an OAC polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:77.

In some embodiments, the one or more heterologous nucleic acids encoding an OAC polypeptide comprise the nucleotide sequence set forth in SEQ ID NO:163. In some embodiments, the one or more heterologous nucleic acids encoding an OAC polypeptide comprise the nucleotide sequence set forth in SEQ ID NO:163, or a codon degenerate nucleotide sequence thereof. In some embodiments, the one or more heterologous nucleic acids encoding an OAC polypeptide comprise a nucleotide sequence having at least 80%, at least 81%, at least 82%, at least 83%, or at least 84% sequence identity to SEQ ID NO:163. In some embodiments, the one or more heterologous nucleic acids encoding an OAC polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:163.

In some embodiments, the one or more heterologous nucleic acids encoding a TKS/OAC polypeptide comprise the nucleotide sequence set forth in SEQ ID NO:79. In some embodiments, the one or more heterologous nucleic acids encoding a TKS/OAC polypeptide comprise the nucleotide sequence set forth in SEQ ID NO:79, or a codon degenerate nucleotide sequence thereof. In some embodiments, the one or more heterologous nucleic acids encoding a TKS/OAC polypeptide comprise a nucleotide sequence having at least 80%, at least 81%, at least 82%, at least 83%, or at least 84% sequence identity to SEQ ID NO:79. In some embodiments, the one or more heterologous nucleic acids encoding a TKS/OAC polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:79. In some embodiments, the one or more heterologous nucleic acids encoding a TKS/OAC polypeptide comprise a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:79.

Polypeptides that Generate Geranyl Pyrophosphate, Nucleic Acids Comprising Said Polypeptides, and Genetically Modified Host Cells Expressing Said Polypeptides In some embodiments, a genetically modified host cell of the present disclosure is genetically modified with one or more heterologous nucleic acids encoding a polypeptide that generates GPP. In some embodiments, the polypeptide that generates GPP is a geranyl diphosphate synthase (GPPS) polypeptide. In some embodiments, the GPPS polypeptide also has a farnesyl diphosphate synthase (FPPS) polypeptide activity. In some embodiments, the GPPS polypeptide is modified such that it has reduced FPPS polypeptide activity (e.g., at least 10%, 20%, 30%, 40%, 50%, 60%, 70%, 80%, 90%, or more than 90%, less FPPS polypeptide activity) than the corresponding wild-type or parental GPPS polypeptide from which the modified GPPS polypeptide is derived. In some embodiments, the GPPS polypeptide is modified such that it has substantially no FPPS polypeptide activity. In some embodiments, a genetically modified host cell of the present disclosure is genetically modified with one or more heterologous nucleic acids encoding a GPPS polypeptide.

Exemplary GPPS polypeptides disclosed herein may include a full-length GPPS polypeptide, a fragment of a GPPS polypeptide, a variant of a GPPS polypeptide, a truncated GPPS polypeptide, or a fusion polypeptide that has at least one activity of a GPPS polypeptide. In some embodiments, the one or more polypeptides that generate GPP or are part of a biosynthetic pathway that generates GPP are one or more polypeptides having at least one activity of a polypeptide present in the mevalonate (MEV) pathway. In some embodiments, the one or more polypeptides that generate GPP or are part of a biosynthetic pathway that generates GPP are one or more polypeptides having at least one activity of a polypeptide present in the DXP pathway.

In some embodiments, the GPPS polypeptide encoded by the one or more heterologous nucleic acids comprises the amino acid sequence set forth in SEQ ID NO:7, SEQ ID NO:8, or SEQ ID NO:60. In some embodiments, the GPPS polypeptide encoded by the one or more heterologous nucleic acids comprises the amino acid sequence set forth in SEQ ID NO:7, SEQ ID NO:8, or SEQ ID NO:60, or a conservatively substituted amino acid sequence thereof. In some embodiments, the GPPS polypeptide encoded by the one or more heterologous nucleic acids comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:7, SEQ ID NO:8, or SEQ ID NO:60.

In some embodiments, the GPPS polypeptide encoded by the one or more heterologous nucleic acids comprises the amino acid sequence set forth in SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO:141, SEQ ID NO:143, or SEQ ID NO:203. In some embodiments, the GPPS polypeptide encoded by the one or more heterologous nucleic acids comprises the amino acid sequence set forth in SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO:141, SEQ ID NO:143, or SEQ ID NO:203, or a conservatively substituted amino acid sequence thereof. In some embodiments, the GPPS polypeptide encoded by the one or more heterologous nucleic acids comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO:141, SEQ ID NO:143, or SEQ ID NO:203.

In some embodiments, the GPPS polypeptide encoded by the one or more heterologous nucleic acids comprises the amino acid sequence set forth in SEQ ID NO:5 or SEQ ID NO:6. In some embodiments, the GPPS polypeptide encoded by the one or more heterologous nucleic acids comprises the amino acid sequence set forth in SEQ ID NO:5 or SEQ ID NO:6, or a conservatively substituted amino acid sequence thereof. In some embodiments, the GPPS polypeptide encoded by the one or more heterologous nucleic acids comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:5 or SEQ ID NO:6.

In some embodiments, a genetically modified host cell of the present disclosure is genetically modified with: i) one or more heterologous nucleic acids that encode a GPPS polypeptide comprising an amino acid sequence as set forth in SEQ ID NO:5; and ii) one or more heterologous nucleic acids that encode a GPPS polypeptide comprising an amino acid sequence as set forth in SEQ ID NO:6.

In some embodiments, the GPPS (Erg20) polypeptide encoded by the one or more heterologous nucleic acids comprises the amino acid sequence set forth in SEQ ID NO:7. In some embodiments, the GPPS (Erg20) polypeptide encoded by the one or more heterologous nucleic acids comprises the amino acid sequence set forth in SEQ ID NO:7, or a conservatively substituted amino acid sequence thereof. In some embodiments, the GPPS (Erg20) polypeptide encoded by the one or more heterologous nucleic acids comprises an amino acid sequence having at least 50%, at least 55%, at least 60%, at least 65%, at least 70%, or at least 75% amino acid sequence identity to SEQ ID NO:7. In some embodiments, the GPPS (Erg20) polypeptide encoded by the one or more heterologous nucleic acids comprises an amino acid sequence having at least 80%, at least 81%, at least 82%, at least 83%, or at least 84% amino acid sequence identity to SEQ ID NO:7. In some embodiments, the GPPS (Erg20) polypeptide encoded by the one or more heterologous nucleic acids comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:7.

In some embodiments, the GPPS (Erg20 (K197G)) polypeptide encoded by the one or more heterologous nucleic acids comprises the amino acid sequence set forth in SEQ ID NO:8. In some embodiments, the GPPS (Erg20 (K197G)) polypeptide encoded by the one or more heterologous nucleic acids comprises the amino acid sequence set forth in SEQ ID NO:8, or a conservatively substituted amino acid sequence thereof. In some embodiments, the GPPS (Erg20 (K197G)) polypeptide encoded by the one or more heterologous nucleic acids comprises an amino acid sequence having at least 50%, at least 55%, at least 60%, at least 65%, at least 70%, or at least 75% amino acid sequence identity to SEQ ID NO:8. In some embodiments, the GPPS (Erg20 (K197G)) polypeptide encoded by the one or more heterologous nucleic acids comprises an amino acid sequence having at least 80%, at least 81%, at least 82%, at least 83%, or at least 84% amino acid sequence identity to SEQ ID NO:8. In some embodiments, the GPPS (Erg20 (K197G)) polypeptide encoded by the one or more heterologous nucleic acids comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:8. The GPPS (Erg20

(K197G)) polypeptide encoded by the one or more heterologous nucleic acids comprises the amino acid sequence set forth in SEQ ID NO:8 comprises a K197G amino acid substitution relative to the GPPS amino acid sequence set forth in SEQ ID NO:7. This mutation shifts the ratio of GPP to farnesyl diphosphate (FPP), increasing the production of the GPP required to produce CBDA.

In some embodiments, a genetically modified host cell of the present disclosure is genetically modified with one or more heterologous nucleic acids encoding a GPPS large subunit polypeptide and a GPPS small subunit polypeptide, where the GPPS large subunit polypeptide and the GPPS small subunit polypeptide together form a heterodimeric GPPS polypeptide. In some embodiments, the GPPS large subunit polypeptide encoded by the one or more heterologous nucleic acids comprises the amino acid sequence set forth in SEQ ID NO:72. In some embodiments, the GPPS large subunit polypeptide encoded by the one or more heterologous nucleic acids comprises the amino acid sequence set forth in SEQ ID NO:72, or a conservatively substituted amino acid sequence thereof. In some embodiments, the CAPPS large subunit polypeptide encoded by the one or more heterologous nucleic acids comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:72. In some embodiments, the CAPPS small subunit polypeptide encoded by the one or more heterologous nucleic acids comprises the amino acid sequence set forth in SEQ ID NO:74. In some embodiments, the GPPS small subunit polypeptide encoded by the one or more heterologous nucleic acids comprises the amino acid sequence set forth in SEQ ID NO:74, or a conservatively substituted amino acid sequence thereof. In some embodiments, the GPPS small subunit polypeptide encoded by the one or more heterologous nucleic acids comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:74.

In some embodiments, the GPPS polypeptide encoded by the one or more heterologous nucleic acids is an ERG20mut (F96W, N127W) polypeptide and comprises the amino acid sequence set forth in SEQ ID NO:60. In some embodiments, the GPPS polypeptide encoded by the one or more heterologous nucleic acids is an ERG20mut (F96W, N127W) polypeptide and comprises the amino acid sequence set forth in SEQ ID NO:60, or a conservatively substituted amino acid sequence thereof. In some embodiments, the GPPS polypeptide encoded by the one or more heterologous nucleic acids is an ERG20mut (F96W, N127W) polypeptide and comprises an amino acid sequence having at least 50%, at least 55%, at least 60%, at least 65%, at least 70%, or at least 75% amino acid sequence identity to SEQ ID NO:60. In some embodiments, the GPPS polypeptide encoded by the one or more heterologous nucleic acids is an ERG20mut (F96W, N127W) polypeptide and comprises an amino acid sequence having at least 80%, at least 81%, at least 82%, at least 83%, or at least 84% amino acid sequence identity to SEQ ID NO:60. In some embodiments, the GPPS polypeptide encoded by the one or more heterologous nucleic acids is an ERG20mut (F96W, N127W) polypeptide and comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:60. This mutation shifts the ratio of GPP to farnesyl diphosphate (FPP), increasing the production of the GPP required to produce CBDA.

In some embodiments, the GPPS polypeptide encoded by the one or more heterologous nucleic acids comprises the amino acid sequence set forth in SEQ ID NO:121. In some embodiments, the GPPS polypeptide encoded by the one or more heterologous nucleic acids comprises the amino acid sequence set forth in SEQ ID NO:121, or a conservatively substituted amino acid sequence thereof. In some embodiments, the GPPS polypeptide encoded by the one or more heterologous nucleic acids comprises an amino acid sequence having at least 50%, at least 55%, at least 60%, at least 65%, at least 70%, or at least 75% amino acid sequence identity to SEQ ID NO:121. In some embodiments, the GPPS polypeptide encoded by the one or more heterologous nucleic acids comprises an amino acid sequence having at least 80%, at least 81%, at least 82%, at least 83%, or at least 84% amino acid sequence identity to SEQ ID NO:121. In some embodiments, the GPPS polypeptide encoded by the one or more heterologous nucleic acids comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:121.

In some embodiments, the GPPS polypeptide encoded by the one or more heterologous nucleic acids comprises the amino acid sequence set forth in SEQ ID NO:123. In some embodiments, the GPPS polypeptide encoded by the one or more heterologous nucleic acids comprises the amino acid sequence set forth in SEQ ID NO:123, or a conservatively substituted amino acid sequence thereof. In some embodiments, the GPPS polypeptide encoded by the one or more heterologous nucleic acids comprises an amino acid sequence having at least 50%, at least 55%, at least 60%, at least 65%, at least 70%, or at least 75% amino acid sequence identity to SEQ ID NO:123. In some embodiments, the GPPS polypeptide encoded by the one or more heterologous nucleic acids comprises an amino acid sequence having at least 80%, at least 81%, at least 82%, at least 83%, or at least 84% amino acid sequence identity to SEQ ID NO:123. In some embodiments, the GPPS polypeptide encoded by the one or more heterologous nucleic acids comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:123.

In some embodiments, the GPPS polypeptide encoded by the one or more heterologous nucleic acids comprises the amino acid sequence set forth in SEQ ID NO:125. In some embodiments, the GPPS polypeptide encoded by the one or more heterologous nucleic acids comprises the amino acid sequence set forth in SEQ ID NO:125, or a conservatively substituted amino acid sequence thereof. In some embodiments, the GPPS polypeptide encoded by the one or more heterologous nucleic acids comprises an amino acid sequence having at least 50%, at least 55%, at least 60%, at least 65%, at least 70%, or at least 75% amino acid sequence identity to SEQ ID NO:125. In some embodiments, the GPPS polypeptide encoded by the one or more heterologous nucleic acids comprises an amino acid sequence having at least 80%, at least 81%, at least 82%, at least 83%, or at least 84% amino acid sequence identity to SEQ ID NO:125. In some embodiments, the GPPS polypeptide encoded by the one or more heterologous nucleic acids comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:125.

In some embodiments, the GPPS polypeptide encoded by the one or more heterologous nucleic acids comprises the amino acid sequence set forth in SEQ ID NO:127. In some embodiments, the GPPS polypeptide encoded by the one or more heterologous nucleic acids comprises the amino acid sequence set forth in SEQ ID NO:127, or a conservatively substituted amino acid sequence thereof. In some embodiments, the GPPS polypeptide encoded by the one or more heterologous nucleic acids comprises an amino acid sequence having at least 50%, at least 55%, at least 60%, at least 65%, at least 70%, or at least 75% amino acid sequence identity to SEQ ID NO:127. In some embodiments, the GPPS polypeptide encoded by the one or more heterologous nucleic acids comprises an amino acid sequence having at least 80%, at least 81%, at least 82%, at least 83%, or at least 84% amino acid sequence identity to SEQ ID NO:127. In some embodiments, the GPPS polypeptide encoded by the one or more heterologous nucleic acids comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:127.

In some embodiments, the GPPS polypeptide encoded by the one or more heterologous nucleic acids comprises the amino acid sequence set forth in SEQ ID NO:129. In some embodiments, the GPPS polypeptide encoded by the one or more heterologous nucleic acids comprises the amino acid sequence set forth in SEQ ID NO:129, or a conservatively substituted amino acid sequence thereof. In some embodiments, the GPPS polypeptide encoded by the one or more heterologous nucleic acids comprises an amino acid sequence having at least 50%, at least 55%, at least 60%, at least 65%, at least 70%, or at least 75% amino acid sequence identity to SEQ ID NO:129. In some embodiments, the GPPS polypeptide encoded by the one or more heterologous nucleic acids comprises an amino acid sequence having at least 80%, at least 81%, at least 82%, at least 83%, or at least 84% amino acid sequence identity to SEQ ID NO:129. In some embodiments, the GPPS polypeptide encoded by the one or more heterologous nucleic acids comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:129.

In some embodiments, the GPPS polypeptide encoded by the one or more heterologous nucleic acids comprises the amino acid sequence set forth in SEQ ID NO:131. In some embodiments, the GPPS polypeptide encoded by the one or more heterologous nucleic acids comprises the amino acid sequence set forth in SEQ ID NO:131, or a conservatively substituted amino acid sequence thereof. In some embodiments, the GPPS polypeptide encoded by the one or more heterologous nucleic acids comprises an amino acid sequence having at least 50%, at least 55%, at least 60%, at least 65%, at least 70%, or at least 75% amino acid sequence identity to SEQ ID NO:131. In some embodiments, the GPPS polypeptide encoded by the one or more heterologous nucleic acids comprises an amino acid sequence having at least 80%, at least 81%, at least 82%, at least 83%, or at least 84% amino acid sequence identity to SEQ ID NO:131. In some embodiments, the GPPS polypeptide encoded by the one or more heterologous nucleic acids comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:131.

In some embodiments, the GPPS polypeptide encoded by the one or more heterologous nucleic acids comprises the amino acid sequence set forth in SEQ ID NO:133. In some embodiments, the GPPS polypeptide encoded by the one or more heterologous nucleic acids comprises the amino acid sequence set forth in SEQ ID NO:133, or a conservatively substituted amino acid sequence thereof. In some embodiments, the GPPS polypeptide encoded by the one or more heterologous nucleic acids comprises an amino acid sequence having at least 50%, at least 55%, at least 60%, at least 65%, at least 70%, or at least 75% amino acid sequence identity to SEQ ID NO:133. In some embodiments, the GPPS polypeptide encoded by the one or more heterologous nucleic acids comprises an amino acid sequence having at least 80%, at least 81%, at least 82%, at least 83%, or at least 84% amino acid sequence identity to SEQ ID NO:133. In some embodiments, the GPPS polypeptide encoded by the one or more heterologous nucleic acids comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:133.

In some embodiments, the GPPS polypeptide encoded by the one or more heterologous nucleic acids comprises the amino acid sequence set forth in SEQ ID NO:135. In some embodiments, the GPPS polypeptide encoded by the one or more heterologous nucleic acids comprises the amino acid sequence set forth in SEQ ID NO:135, or a conservatively substituted amino acid sequence thereof. In some embodiments, the GPPS polypeptide encoded by the one or more heterologous nucleic acids comprises an amino acid sequence having at least 50%, at least 55%, at least 60%, at least 65%, at least 70%, or at least 75% amino acid sequence identity to SEQ ID NO:135. In some embodiments, the GPPS polypeptide encoded by the one or more heterologous nucleic acids comprises an amino acid sequence having at least 80%, at least 81%, at least 82%, at least 83%, or at least 84% amino acid sequence identity to SEQ ID NO:135. In some embodiments, the GPPS polypeptide encoded by the one or more heterologous nucleic acids comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:135.

In some embodiments, the GPPS polypeptide encoded by the one or more heterologous nucleic acids comprises the amino acid sequence set forth in SEQ ID NO:137. In some embodiments, the GPPS polypeptide encoded by the one or more heterologous nucleic acids comprises the amino acid sequence set forth in SEQ ID NO:137, or a conservatively substituted amino acid sequence thereof. In some embodiments, the GPPS polypeptide encoded by the one or more heterologous nucleic acids comprises an amino acid sequence having at least 50%, at least 55%, at least 60%, at least 65%, at least 70%, or at least 75% amino acid sequence identity to SEQ ID NO:137. In some embodiments, the GPPS polypeptide encoded by the one or more heterologous nucleic acids comprises an amino acid sequence having at least 80%, at least 81%, at least 82%, at least 83%, or at least 84% amino acid sequence identity to SEQ ID NO:137. In some embodiments, the GPPS polypeptide encoded by the one or more heterologous nucleic acids comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:137.

In some embodiments, the GPPS polypeptide encoded by the one or more heterologous nucleic acids comprises the amino acid sequence set forth in SEQ ID NO:139. In some embodiments, the GPPS polypeptide encoded by the one or more heterologous nucleic acids comprises the amino acid sequence set forth in SEQ ID NO:139, or a conservatively substituted amino acid sequence thereof. In some embodiments, the GPPS polypeptide encoded by the one or more heterologous nucleic acids comprises an amino acid sequence having at least 50%, at least 55%, at least 60%, at least 65%, at least 70%, or at least 75% amino acid sequence identity to SEQ ID NO:139. In some embodiments, the GPPS polypeptide encoded by the one or more heterologous nucleic acids comprises an amino acid sequence having at least 80%, at least 81%, at least 82%, at least 83%, or at least 84% amino acid sequence identity to SEQ ID NO:139. In some embodiments, the GPPS polypeptide encoded by the one or more heterologous nucleic acids comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:139.

In some embodiments, the GPPS polypeptide encoded by the one or more heterologous nucleic acids comprises the amino acid sequence set forth in SEQ ID NO:141. In some embodiments, the GPPS polypeptide encoded by the one or more heterologous nucleic acids comprises the amino acid sequence set forth in SEQ ID NO:141, or a conservatively substituted amino acid sequence thereof. In some embodiments, the GPPS polypeptide encoded by the one or more heterologous nucleic acids comprises an amino acid sequence having at least 50%, at least 55%, at least 60%, at least 65%, at least 70%, or at least 75% amino acid sequence identity to SEQ ID NO:141. In some embodiments, the GPPS polypeptide encoded by the one or more heterologous nucleic acids comprises an amino acid sequence having at least 80%, at least 81%, at least 82%, at least 83%, or at least 84% amino acid sequence identity to SEQ ID NO:141. In some embodiments, the GPPS polypeptide encoded by the one or more heterologous nucleic acids comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:141.

In some embodiments, the GPPS polypeptide encoded by the one or more heterologous nucleic acids comprises the amino acid sequence set forth in SEQ ID NO:143. In some embodiments, the GPPS polypeptide encoded by the one or more heterologous nucleic acids comprises the amino acid sequence set forth in SEQ ID NO:143, or a conservatively substituted amino acid sequence thereof. In some embodiments, the GPPS polypeptide encoded by the one or more heterologous nucleic acids comprises an amino acid sequence having at least 50%, at least 55%, at least 60%, at least 65%, at least 70%, or at least 75% amino acid sequence identity to SEQ ID NO:143. In some embodiments, the GPPS polypeptide encoded by the one or more heterologous nucleic acids comprises an amino acid sequence having at least 80%, at least 81%, at least 82%, at least 83%, or at least 84% amino acid sequence identity to SEQ ID NO:143. In some embodiments, the GPPS polypeptide encoded by the one or more heterologous nucleic acids comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:143.

In some embodiments, the GPPS polypeptide encoded by the one or more heterologous nucleic acids comprises the amino acid sequence set forth in SEQ ID NO:203. In some embodiments, the GPPS polypeptide encoded by the one or more heterologous nucleic acids comprises the amino acid sequence set forth in SEQ ID NO:203, or a conservatively substituted amino acid sequence thereof. In some embodiments, the GPPS polypeptide encoded by the one or more heterologous nucleic acids comprises an amino acid sequence having at least 50%, at least 55%, at least 60%, at least 65%, at least 70%, or at least 75% amino acid sequence identity to SEQ ID NO:203. In some embodiments, the GPPS polypeptide encoded by the one or more heterologous nucleic acids comprises an amino acid sequence having at least 80%, at least 81%, at least 82%, at least 83%, or at least 84% amino acid sequence identity to SEQ ID NO:203. In some embodiments, the GPPS polypeptide encoded by the one or more heterologous nucleic acids comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:203.

Exemplary GPPS heterologous nucleic acids disclosed herein may include nucleic acids that encode a GPPS polypeptide, such as, a full-length GPPS polypeptide, a fragment of a GPPS polypeptide, a variant of a GPPS polypeptide, a truncated GPPS polypeptide, or a fusion polypeptide that has at least one activity of a GPPS polypeptide.

In some embodiments, the GPPS polypeptide is overexpressed in the genetically modified host cell. Overexpression may be achieved by increasing the copy number of the GPPS polypeptide-encoding heterologous nucleic acid, e.g., through use of a high copy number expression vector (e.g., a plasmid that exists at 10-40 copies per cell) and/or by operably linking the GPPS polypeptide-encoding heterologous nucleic acid to a strong promoter. In some embodiments, the genetically modified host cell has one copy of a GPPS polypeptide-encoding heterologous nucleic acid. In some embodiments, the genetically modified host cell has two copies of a GPPS polypeptide-encoding heterologous nucleic acid. In some embodiments, the genetically modified host cell has three copies of a GPPS polypeptide-encoding heterologous nucleic acid. In some embodiments, the genetically modified host cell has four copies of a GPPS polypeptide-encoding heterologous nucleic acid. In some embodiments, the genetically modified host cell has five copies of a GPPS polypeptide-encoding heterologous nucleic acid. In some embodiments, the genetically modified host cell has six copies of a GPPS polypeptide-encoding heterologous nucleic acid. In some embodiments, the genetically modified host cell has seven copies of a GPPS polypeptide-encoding heterologous nucleic acid. In some embodiments, the genetically modified host cell has eight copies of a GPPS polypeptide-encoding heterologous nucleic acid.

In some embodiments, the one or more heterologous nucleic acids encoding a GPPS polypeptide comprise the nucleotide sequence set forth in SEQ ID NO:122, SEQ ID NO:124, SEQ ID NO:126, SEQ ID NO:128, SEQ ID NO:130, SEQ ID NO:132, SEQ ID NO:134, SEQ ID NO:136, SEQ ID NO:138, SEQ ID NO:140, SEQ ID NO:142, SEQ ID NO:144, or SEQ ID NO:202. In some embodiments, the one or more heterologous nucleic acids encoding a GPPS polypeptide comprise the nucleotide sequence set forth in SEQ ID NO:122, SEQ ID NO:124, SEQ ID NO:126, SEQ ID NO:128, SEQ ID NO:130, SEQ ID NO:132, SEQ ID NO:134, SEQ ID NO:136, SEQ ID NO:138, SEQ ID NO:140, SEQ ID NO:142, SEQ ID NO:144, or SEQ ID NO:202, or a codon degenerate nucleotide sequence thereof. In some embodiments, the one or more heterologous nucleic acids encoding a GPPS polypeptide comprise a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:122, SEQ ID NO:124, SEQ ID NO:126, SEQ ID NO:128, SEQ ID NO:130, SEQ ID NO:132, SEQ ID NO:134, SEQ ID NO:136, SEQ ID NO:138, SEQ ID NO:140, SEQ ID NO:142, SEQ ID NO:144, or SEQ ID NO:202.

In some embodiments, the one or more heterologous nucleic acids encoding a GPPS polypeptide comprise the nucleotide sequence set forth in SEQ ID NO:71 and/or SEQ ID NO:73. In some embodiments, the one or more heterologous nucleic acids encoding a GPPS polypeptide comprise the nucleotide sequence set forth in SEQ ID NO:71 and/or SEQ ID NO:73, or a codon degenerate nucleotide sequence thereof. In some embodiments, the one or more heterologous nucleic acids encoding a GPPS polypeptide comprise a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:71 and/or SEQ ID NO:73.

In some embodiments, the one or more heterologous nucleic acids encoding a GPPS polypeptide (ERG20mut (F96W, N127W)) comprise the nucleotide sequence set forth in SEQ ID NO:59. In some embodiments, the one or more heterologous nucleic acids encoding a GPPS polypeptide (ERG20mut (F96W, N127W)) comprise the nucleotide sequence set forth in SEQ ID NO:59, or a codon degenerate nucleotide sequence thereof. In some embodiments, the one or more heterologous nucleic acids encoding a GPPS polypeptide (ERG20mut (F96W, N127W)) comprise a nucleotide sequence having at least 80%, at least 81%, at least 82%, at least 83%, or at least 84% sequence identity to SEQ ID NO:59. In some embodiments, the one or more heterologous nucleic acids encoding a GPPS polypeptide (ERG20mut (F96W, N127W)) comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:59.

In some embodiments, the one or more heterologous nucleic acids encoding a GPPS polypeptide (ERG20mut (F96W, N127W)) comprise the nucleotide sequence set forth in SEQ ID NO:161. In some embodiments, the one or more heterologous nucleic acids encoding a GPPS polypeptide (ERG20mut (F96W, N127W)) comprise the nucleotide sequence set forth in SEQ ID NO:161, or a codon degenerate nucleotide sequence thereof. In some embodiments, the one or more heterologous nucleic acids encoding a GPPS polypeptide (ERG20mut (F96W, N127W)) comprise a nucleotide sequence having at least 80%, at least 81%, at least 82%, at least 83%, or at least 84% sequence identity to SEQ ID NO:161. In some embodiments, the one or more heterologous nucleic acids encoding a GPPS polypeptide (ERG20mut (F96W, N127W)) comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:161. In some embodiments, the one or more heterologous nucleic acids encoding a GPPS polypeptide (ERG20mut (F96W, N127W)) comprise a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:161.

In some embodiments, the one or more heterologous nucleic acids encoding a GPPS polypeptide comprise the nucleotide sequence set forth in SEQ ID NO:122. In some embodiments, the one or more heterologous nucleic acids encoding a GPPS polypeptide comprise the nucleotide sequence set forth in SEQ ID NO:122, or a codon degenerate nucleotide sequence thereof. In some embodiments, the one or more heterologous nucleic acids encoding a GPPS polypeptide comprise a nucleotide sequence having at least 80%, at least 81%, at least 82%, at least 83%, or at least 84% sequence identity to SEQ ID NO:122. In some embodiments, the one or more heterologous nucleic acids encoding a GPPS polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:122.

In some embodiments, the one or more heterologous nucleic acids encoding a GPPS polypeptide comprise the nucleotide sequence set forth in SEQ ID NO:124. In some embodiments, the one or more heterologous nucleic acids encoding a GPPS polypeptide comprise the nucleotide sequence set forth in SEQ ID NO:124, or a codon degenerate nucleotide sequence thereof. In some embodiments, the one or more heterologous nucleic acids encoding a GPPS polypeptide comprise a nucleotide sequence having at least 80%, at least 81%, at least 82%, at least 83%, or at least 84% sequence identity to SEQ ID NO:124. In some embodiments, the one or more heterologous nucleic acids encoding a GPPS polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:124.

In some embodiments, the one or more heterologous nucleic acids encoding a GPPS polypeptide comprise the nucleotide sequence set forth in SEQ ID NO:126. In some embodiments, the one or more heterologous nucleic acids encoding a GPPS polypeptide comprise the nucleotide sequence set forth in SEQ ID NO:126, or a codon degenerate nucleotide sequence thereof. In some embodiments, the one or more heterologous nucleic acids encoding a GPPS polypeptide comprise a nucleotide sequence having at least 80%, at least 81%, at least 82%, at least 83%, or at least 84% sequence identity to SEQ ID NO:126. In some embodiments, the one or more heterologous nucleic acids encoding a GPPS polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:126.

In some embodiments, the one or more heterologous nucleic acids encoding a GPPS polypeptide comprise the nucleotide sequence set forth in SEQ ID NO:128. In some embodiments, the one or more heterologous nucleic acids encoding a GPPS polypeptide comprise the nucleotide sequence set forth in SEQ ID NO:128, or a codon degenerate nucleotide sequence thereof. In some embodiments, the one or more heterologous nucleic acids encoding a GPPS polypeptide comprise a nucleotide sequence having at least 80%, at least 81%, at least 82%, at least 83%, or at least 84% sequence identity to SEQ ID NO:128. In some embodiments, the one or more heterologous nucleic acids encoding a GPPS polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:128.

In some embodiments, the one or more heterologous nucleic acids encoding a GPPS polypeptide comprise the nucleotide sequence set forth in SEQ ID NO:130. In some embodiments, the one or more heterologous nucleic acids encoding a GPPS polypeptide comprise the nucleotide sequence set forth in SEQ ID NO:130, or a codon degenerate nucleotide sequence thereof. In some embodiments, the one or more heterologous nucleic acids encoding a GPPS polypeptide comprise a nucleotide sequence having at least 80%, at least 81%, at least 82%, at least 83%, or at least 84% sequence identity to SEQ ID NO:130. In some embodiments, the one or more heterologous nucleic acids encoding a GPPS polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:130.

In some embodiments, the one or more heterologous nucleic acids encoding a GPPS polypeptide comprise the nucleotide sequence set forth in SEQ ID NO:132. In some embodiments, the one or more heterologous nucleic acids encoding a GPPS polypeptide comprise the nucleotide sequence set forth in SEQ ID NO:132, or a codon degenerate nucleotide sequence thereof. In some embodiments, the one or more heterologous nucleic acids encoding a GPPS polypeptide comprise a nucleotide sequence having at least 80%, at least 81%, at least 82%, at least 83%, or at least 84% sequence identity to SEQ ID NO:132. In some embodiments, the one or more heterologous nucleic acids encoding a GPPS polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:132.

In some embodiments, the one or more heterologous nucleic acids encoding a GPPS polypeptide comprise the nucleotide sequence set forth in SEQ ID NO:134. In some embodiments, the one or more heterologous nucleic acids encoding a GPPS polypeptide comprise the nucleotide sequence set forth in SEQ ID NO:134, or a codon degenerate nucleotide sequence thereof. In some embodiments, the one or more heterologous nucleic acids encoding a GPPS polypeptide comprise a nucleotide sequence having at least 80%, at least 81%, at least 82%, at least 83%, or at least 84% sequence identity to SEQ ID NO:134. In some embodiments, the one or more heterologous nucleic acids encoding a GPPS polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:134.

In some embodiments, the one or more heterologous nucleic acids encoding a GPPS polypeptide comprise the nucleotide sequence set forth in SEQ ID NO:136. In some embodiments, the one or more heterologous nucleic acids encoding a GPPS polypeptide comprise the nucleotide sequence set forth in SEQ ID NO:136, or a codon degenerate nucleotide sequence thereof. In some embodiments, the one or more heterologous nucleic acids encoding a GPPS polypeptide comprise a nucleotide sequence having at least 80%, at least 81%, at least 82%, at least 83%, or at least 84% sequence identity to SEQ ID NO:136. In some embodiments, the one or more heterologous nucleic acids encoding a GPPS polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:136.

In some embodiments, the one or more heterologous nucleic acids encoding a GPPS polypeptide comprise the nucleotide sequence set forth in SEQ ID NO:138. In some embodiments, the one or more heterologous nucleic acids encoding a GPPS polypeptide comprise the nucleotide sequence set forth in SEQ ID NO:138, or a codon degenerate nucleotide sequence thereof. In some embodiments, the one or more heterologous nucleic acids encoding a GPPS polypeptide comprise a nucleotide sequence having at least 80%, at least 81%, at least 82%, at least 83%, or at least 84% sequence identity to SEQ ID NO:138. In some embodiments, the one or more heterologous nucleic acids encoding a GPPS polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:138.

In some embodiments, the one or more heterologous nucleic acids encoding a GPPS polypeptide comprise the nucleotide sequence set forth in SEQ ID NO:140. In some embodiments, the one or more heterologous nucleic acids encoding a GPPS polypeptide comprise the nucleotide sequence set forth in SEQ ID NO:140, or a codon degenerate nucleotide sequence thereof. In some embodiments, the one or more heterologous nucleic acids encoding a GPPS polypeptide comprise a nucleotide sequence having at least 80%, at least 81%, at least 82%, at least 83%, or at least 84% sequence identity to SEQ ID NO:140. In some embodiments, the one or more heterologous nucleic acids encoding a GPPS polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:140.

In some embodiments, the one or more heterologous nucleic acids encoding a GPPS polypeptide comprise the nucleotide sequence set forth in SEQ ID NO:142. In some embodiments, the one or more heterologous nucleic acids encoding a GPPS polypeptide comprise the nucleotide sequence set forth in SEQ ID NO:142, or a codon degenerate nucleotide sequence thereof. In some embodiments, the one or more heterologous nucleic acids encoding a GPPS polypeptide comprise a nucleotide sequence having at least 80%, at least 81%, at least 82%, at least 83%, or at least 84% sequence identity to SEQ ID NO:142. In some embodiments, the one or more heterologous nucleic acids encoding a GPPS polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:142.

In some embodiments, the one or more heterologous nucleic acids encoding a GPPS polypeptide comprise the nucleotide sequence set forth in SEQ ID NO:144. In some embodiments, the one or more heterologous nucleic acids encoding a GPPS polypeptide comprise the nucleotide sequence set forth in SEQ ID NO:144, or a codon degenerate nucleotide sequence thereof. In some embodiments, the one or more heterologous nucleic acids encoding a GPPS polypeptide comprise a nucleotide sequence having at least 80%, at least 81%, at least 82%, at least 83%, or at least 84% sequence identity to SEQ ID NO:144. In some embodiments, the one or more heterologous nucleic acids encoding a GPPS polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:144.

In some embodiments, the one or more heterologous nucleic acids encoding a GPPS polypeptide comprise the nucleotide sequence set forth in SEQ ID NO:202. In some embodiments, the one or more heterologous nucleic acids encoding a GPPS polypeptide comprise the nucleotide sequence set forth in SEQ ID NO:202, or a codon degenerate nucleotide sequence thereof. In some embodiments, the one or more heterologous nucleic acids encoding a GPPS polypeptide comprise a nucleotide sequence having at least 80%, at least 81%, at least 82%, at least 83%, or at least 84% sequence identity to SEQ ID NO:202. In some embodiments, the one or more heterologous nucleic acids encoding a GPPS polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:202.

NphB Polypeptides, Nucleic Acids Comprising Said Polypeptides, and Genetically Modified Host Cells Expressing Said Polypeptides In some embodiments, a NphB polypeptide is used instead of a GOT polypeptide to generate cannabigerolic acid from GPP and olivetolic acid. In some embodiments, a genetically modified host cell of the present disclosure is genetically modified with one or more heterologous nucleic acids encoding a NphB polypeptide.

Exemplary NphB polypeptides disclosed herein may include a full-length NphB polypeptide, a fragment of a NphB polypeptide, a variant of a NphB polypeptide, a truncated NphB polypeptide, or a fusion polypeptide that has at least one activity of a NphB polypeptide.

In some embodiments, the NphB polypeptide encoded by the one or more heterologous nucleic acids comprises the amino acid sequence set forth in SEQ ID NO:84. In some embodiments, the NphB polypeptide encoded by the one or more heterologous nucleic acids comprises the amino acid sequence set forth in SEQ ID NO:84, or a conservatively substituted amino acid sequence thereof. In some embodiments, the NphB polypeptide encoded by the one or more heterologous nucleic acids comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:84.

Exemplary NphB heterologous nucleic acids disclosed herein may include nucleic acids that encode a NphB polypeptide, such as, a full-length NphB polypeptide, a fragment of a NphB polypeptide, a variant of a NphB polypeptide, a truncated NphB polypeptide, or a fusion polypeptide that has at least one activity of a NphB polypeptide.

In some embodiments, the NphB polypeptide is overexpressed in the genetically modified host cell. Overexpression may be achieved by increasing the copy number of the NphB polypeptide-encoding heterologous nucleic acid, e.g., through use of a high copy number expression vector (e.g., a plasmid that exists at 10-40 copies per cell) and/or by operably linking the NphB polypeptide-encoding heterologous nucleic acid to a strong promoter. In some embodiments, the genetically modified host cell has one copy of a NphB polypeptide-encoding heterologous nucleic acid. In some embodiments, the genetically modified host cell has two copies of a NphB polypeptide-encoding heterologous nucleic acid. In some embodiments, the genetically modified host cell has three copies of a NphB polypeptide-encoding heterologous nucleic acid. In some embodiments, the genetically modified host cell has four copies of a NphB polypeptide-encoding heterologous nucleic acid. In some embodiments, the genetically modified host cell has five copies of a NphB polypeptide-encoding heterologous nucleic acid. In some embodiments, the genetically modified host cell has six copies of a NphB polypeptide-encoding heterologous nucleic acid. In some embodiments, the genetically modified host cell has seven copies of a NphB polypeptide-encoding heterologous nucleic acid. In some embodiments, the genetically modified host cell has eight copies of a NphB polypeptide-encoding heterologous nucleic acid.

In some embodiments, the one or more heterologous nucleic acids encoding a NphB polypeptide comprise the nucleotide sequence set forth in SEQ ID NO:83. In some embodiments, the one or more heterologous nucleic acids encoding a NphB polypeptide comprise the nucleotide sequence set forth in SEQ ID NO:83, or a codon degenerate nucleotide sequence thereof. In some embodiments, the one or more heterologous nucleic acids encoding a NphB polypeptide comprise a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:83.

Polypeptides that Generate Neryl Pyrophosphate or Cannabinerolic Acid, Nucleic Acids Comprising Said Polypeptides, and Genetically Modified Host Cells Expressing Said Polypeptides In some embodiments, a genetically modified host cell of the present disclosure is genetically modified with one or more heterologous nucleic acids encoding a neryl pyrophosphate (NPP) synthase (NPPS) polypeptide (FIG. 11). NPP and olivetolic acid may be substrates to generate cannabinerolic acid (CBNRA). In some embodiments, a GOT polypeptide acts on NPP and an olivetolic acid derivative (as described elsewhere herein) to generate a CBNRA derivative. Cannabinerolic acid or derivatives thereof can serve as a substrate for a CBDAS or THCAS polypeptide to generate CBDA or THCA, or derivatives thereof, respectively.

Exemplary NPPS polypeptides disclosed herein may include a fragment of a NPPS polypeptide, a variant of a NPPS polypeptide, a full-length NPPS polypeptide, a truncated NPPS polypeptide, or a fusion polypeptide that has at least one activity of a NPPS polypeptide.

In some embodiments, the NPPS polypeptide encoded by the one or more heterologous nucleic acids comprises the amino acid sequence set forth in SEQ ID NO:70. In some embodiments, the NPPS polypeptide encoded by the one or more heterologous nucleic acids comprises the amino acid sequence set forth in SEQ ID NO:70, or a conservatively substituted amino acid sequence thereof. In some embodiments, the NPPS polypeptide encoded by the one or more heterologous nucleic acids comprises an amino acid sequence having at least 50%, at least 55%, at least 60%, at least 65%, at least 70%, or at least 75% amino acid sequence identity to SEQ ID NO:70. In some embodiments, the NPPS polypeptide encoded by the one or more heterologous nucleic acids comprises an amino acid sequence having at least 80%, at least 81%, at least 82%, at least 83%, or at least 84% amino acid sequence identity to SEQ ID NO:70. In some embodiments, the NPPS polypeptide encoded by the one or more heterologous nucleic acids comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:70. In some embodiments, the NPPS polypeptide encoded by the one or more heterologous nucleic acids comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:70.

Exemplary NPPS heterologous nucleic acids disclosed herein may include nucleic acids that encode a NPPS polypeptide, such as, a full-length NPPS polypeptide, a fragment of a NPPS polypeptide, a variant of a NPPS polypeptide, a truncated NPPS polypeptide, or a fusion polypeptide that has at least one activity of a NPPS polypeptide.

In some embodiments, the NPPS polypeptide is overexpressed in the genetically modified host cell. Overexpression may be achieved by increasing the copy number of the NPPS polypeptide-encoding heterologous nucleic acid, e.g., through use of a high copy number expression vector (e.g., a plasmid that exists at 10-40 copies per cell) and/or by operably linking the NPPS polypeptide-encoding heterologous nucleic acid to a strong promoter. In some embodiments, the genetically modified host cell has one copy of an NPPS polypeptide-encoding heterologous nucleic acid. In some embodiments, the genetically modified host cell has two copies of an NPPS polypeptide-encoding heterologous nucleic acid. In some embodiments, the genetically modified host cell has three copies of an NPPS polypeptide-encoding heterologous nucleic acid. In some embodiments, the genetically modified host cell has four copies of an NPPS polypeptide-encoding heterologous nucleic acid. In some embodiments, the genetically modified host cell has five copies of an NPPS polypeptide-encoding heterologous nucleic acid. In some embodiments, the genetically modified host cell has six copies of an NPPS polypeptide-encoding heterologous nucleic acid. In some embodiments, the genetically modified host cell has seven copies of an NPPS polypeptide-encoding heterologous nucleic acid. In some embodiments, the genetically modified host cell has eight copies of an NPPS polypeptide-encoding heterologous nucleic acid.

In some embodiments, the one or more heterologous nucleic acids encoding a NPPS polypeptide comprise the nucleotide sequence set forth in SEQ ID NO:69. In some embodiments, the one or more heterologous nucleic acids encoding a NPPS polypeptide comprise the nucleotide sequence set forth in SEQ ID NO:69, or a codon degenerate nucleotide sequence thereof. In some embodiments, the one or more heterologous nucleic acids encoding a NPPS polypeptide comprise a nucleotide sequence having at least 80%, at least 81%, at least 82%, at least 83%, or at least 84% sequence identity to SEQ ID NO:69. In some embodiments, the one or more heterologous nucleic acids encoding a NPPS polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:69. In some embodiments, the one or more heterologous nucleic acids encoding a NPPS polypeptide comprise a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:69.

Polypeptides that Generate Acetyl-CoA from Pyruvate, Nucleic Acids Comprising Said Polypeptides, and Genetically Modified Host Cells Expressing Said Polypeptides In some embodiments, a genetically modified host cell of the present disclosure is genetically modified with one or more heterologous nucleic acids encoding a polypeptide that generates acetyl-CoA from pyruvate. Polypeptides that generate acetyl-CoA from pyruvate may include a pyruvate decarboxylase (PDC) polypeptide. In some embodiments, a genetically modified host cell of the present disclosure is genetically modified with one or more heterologous nucleic acids encoding a PDC polypeptide.

Exemplary PDC polypeptides disclosed herein may include a full-length PDC polypeptide, a fragment of a PDC polypeptide, a variant of a PDC polypeptide, a truncated PDC polypeptide, or a fusion polypeptide that has at least one activity of a PDC polypeptide.

In some embodiments, the PDC polypeptide encoded by the one or more heterologous nucleic acids comprises the amino acid sequence set forth in SEQ ID NO:117. In some embodiments, the PDC polypeptide encoded by the one or more heterologous nucleic acids comprises the amino acid sequence set forth in SEQ ID NO:117, or a conservatively substituted amino acid sequence thereof. In some embodiments, the PDC polypeptide encoded by the one or more heterologous nucleic acids comprises an amino acid sequence having at least 50%, at least 55%, at least 60%, at least 65%, at least 70%, or at least 75% amino acid sequence identity to SEQ ID NO:117. In some embodiments, the PDC polypeptide encoded by the one or more heterologous nucleic acids comprises an amino acid sequence having at least 80%, at least 81%, at least 82%, at least 83%, or at least 84% amino acid sequence identity to SEQ ID NO:117. In some embodiments, the PDC polypeptide encoded by the one or more heterologous nucleic acids comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:117. In some embodiments, the PDC polypeptide encoded by the one or more heterologous nucleic acids comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:117.

Exemplary PDC heterologous nucleic acids disclosed herein may include nucleic acids that encode a PDC polypeptide, such as, a full-length PDC polypeptide, a fragment of a PDC polypeptide, a variant of a PDC polypeptide, a truncated PDC polypeptide, or a fusion polypeptide that has at least one activity of a PDC polypeptide.

In some embodiments, the PDC polypeptide is overexpressed in the genetically modified host cell. Overexpression may be achieved by increasing the copy number of the PDC polypeptide-encoding heterologous nucleic acid, e.g., through use of a high copy number expression vector (e.g., a plasmid that exists at 10-40 copies per cell) and/or by operably linking the PDC polypeptide-encoding heterologous nucleic acid to a strong promoter. In some embodiments, the genetically modified host cell has one copy of a PDC polypeptide-encoding heterologous nucleic acid. In some embodiments, the genetically modified host cell has two copies of a PDC polypeptide-encoding heterologous nucleic acid. In some embodiments, the genetically modified host cell has three copies of a PDC polypeptide-encoding heterologous nucleic acid. In some embodiments, the genetically modified host cell has four copies of a PDC polypeptide-encoding heterologous nucleic acid. In some embodiments, the genetically modified host cell has five copies of a PDC polypeptide-encoding heterologous nucleic acid.

In some embodiments, the one or more heterologous nucleic acids encoding a PDC polypeptide comprise the nucleotide sequence set forth in SEQ ID NO:118. In some embodiments, the one or more heterologous nucleic acids encoding a PDC polypeptide comprise the nucleotide sequence set forth in SEQ ID NO:118, or a codon degenerate nucleotide sequence thereof. In some embodiments, the one or more heterologous nucleic acids encoding a PDC polypeptide comprise a nucleotide sequence having at least 80%, at least 81%, at least 82%, at least 83%, or at least 84% sequence identity to SEQ ID NO:118. In some embodiments, the one or more heterologous nucleic acids encoding a PDC polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:118. In some embodiments, the one or more heterologous nucleic acids encoding a PDC polypeptide comprise a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:118.

Polypeptides that Condense Two Molecules of Acetyl-CoA to Generate Acetoacetyl-CoA, Nucleic Acids Comprising Said Polypeptides, and Genetically Modified Host Cells Expressing Said Polypeptides In some embodiments, the host cell is genetically modified with one or more heterologous nucleic acids encoding a polypeptide that condenses two molecules of acetyl-CoA to generate acetoacetyl-CoA. In some embodiments, the polypeptide that condenses two molecules of acetyl-CoA to generate acetoacetyl-CoA is an acetoacetyl-CoA thiolase (ERG10p) polypeptide. In some embodiments, a genetically modified host cell of the present disclosure is genetically modified with one or more heterologous nucleic acids encoding an acetoacetyl-CoA thiolase polypeptide.

Exemplary acetoacetyl-CoA thiolase polypeptides disclosed herein may include a full-length acetoacetyl-CoA thiolase polypeptide, a fragment of an acetoacetyl-CoA thiolase polypeptide, a variant of an acetoacetyl-CoA thiolase polypeptide, a truncated acetoacetyl-CoA thiolase polypeptide, or a fusion polypeptide that has at least one activity of an acetoacetyl-CoA thiolase polypeptide.

In some embodiments, the acetoacetyl-CoA thiolase (ERG10p) polypeptide encoded by the one or more heterologous nucleic acids comprises the amino acid sequence set forth in SEQ ID NO:25. In some embodiments, the acetoacetyl-CoA thiolase (ERG10p) polypeptide encoded by the one or more heterologous nucleic acids comprises the amino acid sequence set forth in SEQ ID NO:25, or a conservatively substituted amino acid sequence thereof. In some embodiments, the acetoacetyl-CoA thiolase (ERG10p) polypeptide encoded by the one or more heterologous nucleic acids comprises an amino acid sequence having at least 50%, at least 55%, at least 60%, at least 65%, at least 70%, or at least 75% amino acid sequence identity to SEQ ID NO:25. In some embodiments, the acetoacetyl-CoA thiolase (ERG10p) polypeptide encoded by the one or more heterologous nucleic acids comprises an amino acid sequence having at least 80%, at least 81%, at least 82%, at least 83%, or at least 84% amino acid sequence identity to SEQ ID NO:25. In some embodiments, the acetoacetyl-CoA thiolase (ERG10p) polypeptide encoded by the one or more heterologous nucleic acids comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:25. In some embodiments, the acetoacetyl-CoA thiolase (ERG10p) polypeptide encoded by the one or more heterologous nucleic acids comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:25.

Exemplary acetoacetyl-CoA thiolase heterologous nucleic acids disclosed herein may include nucleic acids that encode an acetoacetyl-CoA thiolase polypeptide, such as, a full-length acetoacetyl-CoA thiolase polypeptide, a fragment of an acetoacetyl-CoA thiolase polypeptide, a variant of an acetoacetyl-CoA thiolase polypeptide, a truncated acetoacetyl-CoA thiolase polypeptide, or a fusion polypeptide that has at least one activity of an acetoacetyl-CoA thiolase polypeptide.

In some embodiments, the acetoacetyl-CoA thiolase polypeptide is overexpressed in the genetically modified host cell. Overexpression may be achieved by increasing the copy number of the acetoacetyl-CoA thiolase polypeptide-encoding heterologous nucleic acid, e.g., through use of a high copy number expression vector (e.g., a plasmid that exists at 10-40 copies per cell) and/or by operably linking the acetoacetyl-CoA thiolase polypeptide-encoding heterologous nucleic acid to a strong promoter. In some embodiments, the genetically modified host cell has one copy of an acetoacetyl-CoA thiolase polypeptide-encoding heterologous nucleic acid. In some embodiments, the genetically modified host cell has two copies of an acetoacetyl-CoA thiolase polypeptide-encoding heterologous nucleic acid. In some embodiments, the genetically modified host cell has three copies of an acetoacetyl-CoA thiolase polypeptide-encoding heterologous nucleic acid. In some embodiments, the genetically modified host cell has four copies of an acetoacetyl-CoA thiolase polypeptide-encoding heterologous nucleic acid. In some embodiments, the genetically modified host cell has five copies of an acetoacetyl-CoA thiolase polypeptide-encoding heterologous nucleic acid.

In some embodiments, the one or more heterologous nucleic acids encoding an acetoacetyl-CoA thiolase (ERG10p) polypeptide comprise the nucleotide sequence set forth in SEQ ID NO:157. In some embodiments, the one or more heterologous nucleic acids encoding a ERG-10p polypeptide comprise the nucleotide sequence set forth in SEQ ID NO:157, or a codon degenerate nucleotide sequence thereof. In some embodiments, the one or more heterologous nucleic acids encoding an acetoacetyl-CoA thiolase (ERG10p) polypeptide comprise a nucleotide sequence having at least 80%, at least 81%, at least 82%, at least 83%, or at least 84% sequence identity to SEQ ID NO:157. In some embodiments, the one or more heterologous nucleic acids encoding an acetoacetyl-CoA thiolase (ERG10p) polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:157. In some embodiments, the one or more heterologous nucleic acids encoding an acetoacetyl-CoA thiolase (ERG10p) polypeptide comprise a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:157.

In some embodiments, the one or more heterologous nucleic acids encoding an acetoacetyl-CoA thiolase (ERG10p) polypeptide comprise the nucleotide sequence set forth in SEQ ID NO:209. In some embodiments, the one or more heterologous nucleic acids encoding a ERG10p polypeptide comprise the nucleotide sequence set forth in SEQ ID NO:209, or a codon degenerate nucleotide sequence thereof. In some embodiments, the one or more heterologous nucleic acids encoding an acetoacetyl-CoA thiolase (ERG10p) polypeptide comprise a nucleotide sequence having at least 80%, at least 81%, at least 82%, at least 83%, or at least 84% sequence identity to SEQ ID NO:209. In some embodiments, the one or more heterologous nucleic acids encoding an acetoacetyl-CoA thiolase (ERG10p) polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:209. In some embodiments, the one or more heterologous nucleic acids encoding an acetoacetyl-CoA thiolase (ERG10p) polypeptide comprise a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:209.

Mevalonate Pathway Polypeptides, Nucleic Acids Comprising Said Polypeptides, and Genetically Modified Host Cells Expressing Said Polypeptides In some embodiments, a genetically modified host cell of the present disclosure is genetically modified with one or more heterologous nucleic acids encoding one or more polypeptides having at least one activity of a polypeptide present in the mevalonate (MEV) pathway.

In some embodiments, the one or more polypeptides that generate GPP or are part of a biosynthetic pathway that generates GPP are one or more polypeptides having at least one activity of a polypeptide present in the mevalonate pathway. The mevalonate pathway may comprise polypeptides that catalyze the following steps: (a) condensing two molecules of acetyl-CoA to generate acetoacetyl-CoA (e.g., by action of an acetoacetyl-CoA thiolase polypeptide); (b) condensing acetoacetyl-CoA with acetyl-CoA to form hydroxymethylglutaryl-CoA (HMG-CoA) (e.g., by action of a HMGS polypeptide); (c) converting HMG-CoA to mevalonate (e.g., by action of an HMGR polypeptide); (d) phosphorylating mevalonate to mevalonate 5-phosphate (e.g., by action of a MK polypeptide); (e) converting mevalonate 5-phosphate to mevalonate 5-pyrophosphate by action of a PMK polypeptide); (f) converting mevalonate 5-pyrophosphate to isopentenyl pyrophosphate (e.g., by action of a mevalonate pyrophosphate decarboxylase (MPD or MVD) polypeptide); and (g) converting isopentenyl pyrophosphate to dimethylallyl pyrophosphate (e.g., by action of an isopentenyl pyrophosphate isomerase (IDI) polypeptide).

In some embodiments, a genetically modified host cell of the present disclosure is genetically modified with one or more heterologous nucleic acids encoding a MEV pathway polypeptide. In some embodiments, a genetically modified host cell of the present disclosure is genetically modified with one or more heterologous nucleic acids encoding more than one MEV pathway polypeptide. In some embodiments, a genetically modified host cell of the present disclosure is genetically modified with one or more heterologous nucleic acids encoding more than two MEV pathway polypeptides. In some embodiments, a genetically modified host cell of the present disclosure is genetically modified with one or more heterologous nucleic acids encoding more than three MEV pathway polypeptides. In some embodiments, a genetically modified host cell of the present disclosure is genetically modified with one or more heterologous nucleic acids encoding more than four MEV pathway polypeptides. In some embodiments, a genetically modified host cell of the present disclosure is genetically modified with one or more heterologous nucleic acids encoding more than five MEV pathway polypeptides. In some embodiments, a genetically modified host cell of the present disclosure is genetically modified with one or more heterologous nucleic acids encoding more than six MEV pathway polypeptides. In some embodiments, a genetically modified host cell of the present disclosure is genetically modified with one or more heterologous nucleic acids encoding all MEV pathway polypeptides.

In some embodiments, a genetically modified host cell of the present disclosure is genetically modified with one or more heterologous nucleic acids encoding two MEV pathway polypeptides. In some embodiments, a genetically modified host cell of the present disclosure is genetically modified with one or more heterologous nucleic acids encoding three MEV pathway polypeptides. In some embodiments, a genetically modified host cell of the present disclosure is genetically modified with one or more heterologous nucleic acids encoding four MEV pathway polypeptides. In some embodiments, a genetically modified host cell of the present disclosure is genetically modified with one or more heterologous nucleic acids encoding five MEV pathway polypeptides. In some embodiments, a genetically modified host cell of the present disclosure is genetically modified with one or more heterologous nucleic acids encoding six MEV pathway polypeptides. In some embodiments, a genetically modified host cell of the present disclosure is genetically modified with one or more heterologous nucleic acids encoding 1, 2, 3, 4, 5, 6, or more MEV pathway polypeptides. In some embodiments, a genetically modified host cell of the present disclosure is genetically modified with one or more heterologous nucleic acids encoding 1, 2, 3, 4, 5, or 6 MEV pathway polypeptides.

Exemplary MEV pathway polypeptides disclosed herein may include a full-length MEV pathway polypeptide, a fragment of a MEV pathway polypeptide, a variant of a MEV pathway polypeptide, a truncated MEV pathway polypeptide, or a fusion polypeptide that has at least one activity of a MEV pathway polypeptide. In some embodiments, the one or more MEV pathway polypeptides are selected from the group consisting of an acetoacetyl-CoA thiolase polypeptide, a HMGS polypeptide, an HMGR polypeptide, an MK polypeptide, a PMK polypeptide, an MVD polypeptide, and an IDI polypeptide.

In some embodiments, the HMGS polypeptide encoded by the one or more heterologous nucleic acids comprises the amino acid sequence set forth in SEQ ID NO:23, SEQ ID NO:24, or SEQ ID NO:115. In some embodiments, the HMGS polypeptide encoded by the one or more heterologous nucleic acids comprises the amino acid sequence set forth in SEQ ID NO:23, SEQ ID NO:24, or SEQ ID NO:115, or a conservatively substituted amino acid sequence thereof. In some embodiments, the HMGS polypeptide encoded by the one or more heterologous nucleic acids comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:23, SEQ ID NO:24, or SEQ ID NO:115.

In some embodiments, the HMGS polypeptide encoded by the one or more heterologous nucleic acids is a MvaS polypeptide and comprises the amino acid sequence set forth in SEQ ID NO:23. In some embodiments, the HMGS polypeptide encoded by the one or more heterologous nucleic acids is a MvaS polypeptide and comprises the amino acid sequence set forth in SEQ ID NO:23, or a conservatively substituted amino acid sequence thereof. In some embodiments, the HMGS polypeptide encoded by the one or more heterologous nucleic acids is a MvaS polypeptide and comprises an amino acid sequence having at least 50%, at least 55%, at least 60%, at least 65%, at least 70%, or at least 75% amino acid sequence identity to SEQ ID NO:23. In some embodiments, the HMGS polypeptide encoded by the one or more heterologous nucleic acids is a MvaS polypeptide and comprises an amino acid sequence having at least 80%, at least 81%, at least 82%, at least 83%, or at least 84% amino acid sequence identity to SEQ ID NO:23. In some embodiments, the HMGS polypeptide encoded by the one or more heterologous nucleic acids is a MvaS polypeptide and comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:23.

In some embodiments, the HMGS polypeptide encoded by the one or more heterologous nucleic acids is a MvaS polypeptide and comprises the amino acid sequence set forth in SEQ ID NO:56. In some embodiments, the HMGS polypeptide encoded by the one or more heterologous nucleic acids is a MvaS polypeptide and comprises the amino acid sequence set forth in SEQ ID NO:56, or a conservatively substituted amino acid sequence thereof. In some embodiments, the polypeptide encoded by the one or more heterologous nucleic acids is a MvaS polypeptide and comprises an amino acid sequence having at least 50%, at least 55%, at least 60%, at least 65%, at least 70%, or at least 75% amino acid sequence identity to SEQ ID NO:56. In some embodiments, the HMGS polypeptide encoded by the one or more heterologous nucleic acids is a MvaS polypeptide and comprises an amino acid sequence having at least 80%, at least 81%, at least 82%, at least 83%, or at least 84% amino acid sequence identity to SEQ ID NO:56. In some embodiments, the HMGS polypeptide encoded by the one or more heterologous nucleic acids is a MvaS polypeptide and comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:56.

In some embodiments, the HMGS polypeptide encoded by the one or more heterologous nucleic acids is an ERG13 polypeptide and comprises the amino acid sequence set forth in SEQ ID NO:24. In some embodiments, the HMGS polypeptide encoded by the one or more heterologous nucleic acids is an ERG13 polypeptide and comprises the amino acid sequence set forth in SEQ ID NO:24, or a conservatively substituted amino acid sequence thereof. In some embodiments, the HMGS polypeptide encoded by the one or more heterologous nucleic acids is an ERG13 polypeptide and comprises an amino acid sequence having at least 50%, at least 55%, at least 60%, at least 65%, at least 70%, or at least 75% amino acid sequence identity to SEQ ID NO:24. In some embodiments, the HMGS polypeptide encoded by the one or more heterologous nucleic acids is an ERG13 polypeptide and comprises an amino acid sequence having at least 80%, at least 81%, at least 82%, at least 83%, or at least 84% amino acid sequence identity to SEQ ID NO:24. In some embodiments, the HMGS polypeptide encoded by the one or more heterologous nucleic acids is an ERG13 polypeptide and comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:24.

In some embodiments, the HMGS polypeptide encoded by the one or more heterologous nucleic acids is an ERG13 polypeptide and comprises the amino acid sequence set forth in SEQ ID NO:115. In some embodiments, the HMGS polypeptide encoded by the one or more heterologous nucleic acids is an ERG13 polypeptide and comprises the amino acid sequence set forth in SEQ ID NO:115, or a conservatively substituted amino acid sequence thereof. In some embodiments, the HMGS polypeptide encoded by the one or more heterologous nucleic acids is an ERG13 polypeptide and comprises an amino acid sequence having at least 50%, at least 55%, at least 60%, at least 65%, at least 70%, or at least 75% amino acid sequence identity to SEQ ID NO:115. In some embodiments, the HMS polypeptide encoded by the one or more heterologous nucleic acids is an ERG13 polypeptide and comprises an amino acid sequence having at least 80%, at least 81%, at least 82%, at least 83%, or at least 84% amino acid sequence identity to SEQ ID NO:115. In some embodiments, the HMGS polypeptide encoded by the one or more heterologous nucleic acids is an ERG13 polypeptide and comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:115.

In some embodiments, the HMGR polypeptide encoded by the one or more heterologous nucleic acids is a MvaE polypeptide, and comprises the amino acid sequence set forth in SEQ ID NO:22. In some embodiments, the HMGR polypeptide encoded by the one or more heterologous nucleic acids is a MvaE polypeptide and comprises the amino acid sequence set forth in SEQ ID NO:22, or a conservatively substituted amino acid sequence thereof. In some embodiments, the HMGR polypeptide encoded by the one or more heterologous nucleic acids is a MvaE polypeptide and comprises an amino acid sequence having at least 50%, at least 55%, at least 60%, at least 65%, at least 70%, or at least 75% amino acid sequence identity to SEQ ID NO:22. In some embodiments, the HMGR polypeptide encoded by the one or more heterologous nucleic acids is a MvaE polypeptide and comprises an amino acid sequence having at least 80%, at least 81%, at least 82%, at least 83%, or at least 84% amino acid sequence identity to SEQ ID NO:22, In some embodiments, the HMGR polypeptide encoded by the one or more heterologous nucleic acids is a MvaE polypeptide and comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:22. In some embodiments, the HMGR polypeptide encoded by the one or more heterologous nucleic acids is a MvaE polypeptide and comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:22.

In some embodiments, the HMGR polypeptide encoded by the one or more heterologous nucleic acids is a MvaE polypeptide and comprises the amino acid sequence set forth in SEQ ID NO:54. In some embodiments, the HMGR polypeptide encoded by the one or more heterologous nucleic acids is a MvaE polypeptide and comprises the amino acid sequence set forth in SEQ ID NO:54, or a conservatively substituted amino acid sequence thereof. In some embodiments, the HMGR polypeptide encoded by the one or more heterologous nucleic acids is a MvaE polypeptide and comprises an amino acid sequence having at least 50%, at least 55%, at least 60%, at least 65%, at least 70%, or at least 75% amino acid sequence identity to SEQ ID NO:54. In some embodiments, the HMGR polypeptide encoded by the one or more heterologous nucleic acids is a MvaE polypeptide and comprises an amino acid sequence having at least 80%, at least 81%, at least 82%, at least 83%, or at least 84% amino acid sequence identity to SEQ ID NO:54. In some embodiments, the HMGR polypeptide encoded by the one or more heterologous nucleic acids is a MvaE polypeptide and comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:54.

In some embodiments, the HMGR polypeptide is a truncated HMGR (tHMGR) polypeptide. In some embodiments, the tHMGR polypeptide encoded by the one or more heterologous nucleic acids comprises the amino acid sequence set forth in SEQ ID NO:17, SEQ ID NO:52, SEQ ID NO:113, or SEQ ID NO:208. In some embodiments, the tHMGR polypeptide encoded by the one or more heterologous nucleic acids comprises the amino acid sequence set forth in SEQ ID NO:17, SEQ ID NO:52, SEQ ID NO:113, or SEQ ID NO:208, or a conservatively substituted amino acid sequence thereof. In some embodiments, the tHMGR polypeptide encoded by the one or more heterologous nucleic acids comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:17, SEQ ID NO:52, SEQ ID NO:113, or SEQ ID NO:208.

In some embodiments, the tHMGR polypeptide encoded by the one or more heterologous nucleic acids comprises the amino acid sequence set forth in SEQ ID NO:17. In some embodiments, the tHMGR polypeptide encoded by the one or more heterologous nucleic acids comprises the amino acid sequence set forth in SEQ ID NO:17, or a conservatively substituted amino acid sequence thereof. In some embodiments, the tHMGR polypeptide encoded by the one or more heterologous nucleic acids comprises an amino acid sequence having at least 50%, at least 55%, at least 60%, at least 65%, at least 70%, or at least 75% amino acid sequence identity to SEQ ID NO:17. In some embodiments, the tHMGR polypeptide encoded by the one or more heterologous nucleic acids comprises an amino acid sequence having at least 80%, at least 81%, at least 82%, at least 83%, or at least 84% amino acid sequence identity to SEQ ID NO:17. In some embodiments, the tHMGR polypeptide encoded by the one or more heterologous nucleic acids comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:17.

In some embodiments, the tHMGR polypeptide encoded by the one or more heterologous nucleic acids comprises the amino acid sequence set forth in SEQ ID NO:52. In some embodiments, the tHMGR polypeptide encoded by the one or more heterologous nucleic acids comprises the amino acid sequence set forth in SEQ ID NO:52, or a conservatively substituted amino acid sequence thereof. In some embodiments, the tHMGR polypeptide encoded by the one or more heterologous nucleic acids comprises an amino acid sequence having at least 50%, at least 55%, at least 60%, at least 65%, at least 70%, or at least 75% amino acid sequence identity to SEQ ID NO:52. In some embodiments, the tHMGR polypeptide encoded by the one or more heterologous nucleic acids comprises an amino acid sequence having at least 80%, at least 81%, at least 82%, at least 83%, or at least 84% amino acid sequence identity to SEQ ID NO:52. In some embodiments, the tHMGR polypeptide encoded by the one or more heterologous nucleic acids comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:52.

In some embodiments, the tHMGR polypeptide encoded by the one or more heterologous nucleic acids comprises the amino acid sequence set forth in SEQ ID NO:113. In some embodiments, the tHMGR polypeptide encoded by the one or more heterologous nucleic acids comprises the amino acid sequence set forth in SEQ ID NO:113, or a conservatively substituted amino acid sequence thereof. In some embodiments, the tHMGR polypeptide encoded by the one or more heterologous nucleic acids comprises an amino acid sequence having at least 50%, at least 55%, at least 60%, at least 65%, at least 70%, or at least 75% amino acid sequence identity to SEQ ID NO:113. In some embodiments, the tHMGR polypeptide encoded by the one or more heterologous nucleic acids comprises an amino acid sequence having at least 80%, at least 81%, at least 82%, at least 83%, or at least 84% amino acid sequence identity to SEQ ID NO:113. In some embodiments, the tHMGR polypeptide encoded by the one or more heterologous nucleic acids comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:113.

In some embodiments, the tHMGR polypeptide encoded by the one or more heterologous nucleic acids comprises the amino acid sequence set forth in SEQ ID NO:208. In some embodiments, the tHMGR polypeptide encoded by the one or more heterologous nucleic acids comprises the amino acid sequence set forth in SEQ ID NO:208, or a conservatively substituted amino acid sequence thereof. In some embodiments, the tHMGR polypeptide encoded by the one or more heterologous nucleic acids comprises an amino acid sequence having at least 50%, at least 55%, at least 60%, at least 65%, at least 70%, or at least 75% amino acid sequence identity to SEQ ID NO:208. In some embodiments, the tHMGR polypeptide encoded by the one or more heterologous nucleic acids comprises an amino acid sequence having at least 80%, at least 81%, at least 82%, at least 83%, or at least 84% amino acid sequence identity to SEQ ID NO:208. In some embodiments, the tHMGR polypeptide encoded by the one or more heterologous nucleic acids comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:208.

In some embodiments, the MK (ERG12) polypeptide encoded by the one or more heterologous nucleic acids comprises the amino acid sequence set forth in SEQ ID NO:64. In some embodiments, the MK (ERG12) polypeptide encoded by the one or more heterologous nucleic acids comprises the amino acid sequence set forth in SEQ ID NO:64, or a conservatively substituted amino acid sequence thereof. In some embodiments, the MK (ERG12) polypeptide encoded by the one or more heterologous nucleic acids comprises an amino acid sequence having at least 50%, at least 55%, at least 60%, at least 65%, at least 70%, or at least 75% amino acid sequence identity to SEQ ID NO:64. In some embodiments, the MK (ERG12) polypeptide encoded by the one or more heterologous nucleic acids comprises an amino acid sequence having at least 80%, at least 81%, at least 82%, at least 83%, or at least 84% amino acid sequence identity to SEQ ID NO:64. In some embodiments, the MK (ERG12) polypeptide encoded by the one or more heterologous nucleic acids comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:64. In some embodiments, the MK (ERG12) polypeptide encoded by the one or more heterologous nucleic acids comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:64.

In some embodiments, the PMK polypeptide encoded by the one or more heterologous nucleic acids comprises the amino acid sequence set forth in SEQ ID NO:62 or SEQ ID NO:205. In some embodiments, the PMK polypeptide encoded by the one or more heterologous nucleic acids comprises the amino acid sequence set forth in SEQ ID NO:62 or SEQ ID NO:205, or a conservatively substituted amino acid sequence thereof. In some embodiments, the PMK polypeptide encoded by the one or more heterologous nucleic acids comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:62 or SEQ ID NO:205.

In some embodiments, the PMK polypeptide encoded by the one or more heterologous nucleic acids comprises the amino acid sequence set forth in SEQ ID NO:62. In some embodiments, the PMK polypeptide encoded by the one or more heterologous nucleic acids comprises the amino acid sequence set forth in SEQ ID NO:62, or a conservatively substituted amino acid sequence thereof. In some embodiments, the PMK polypeptide encoded by the one or more heterologous nucleic acids comprises an amino acid sequence having at least 50%, at least 55%, at least 60%, at least 65%, at least 70%, or at least 75% amino acid sequence identity to SEQ ID NO:62. In some embodiments, the PMK polypeptide encoded by the one or more heterologous nucleic acids comprises an amino acid sequence having at least 80%, at least 81%, at least 82%, at least 83%, or at least 84% amino acid sequence identity to SEQ ID NO:62. In some embodiments, the PMK polypeptide encoded by the one or more heterologous nucleic acids comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:62.

In some embodiments, the PMK polypeptide encoded by the one or more heterologous nucleic acids is an ERG8 polypeptide and comprises the amino acid sequence set forth in SEQ ID NO:205. In some embodiments, the PMK polypeptide encoded by the one or more heterologous nucleic acids is an ERG8 polypeptide and comprises the amino acid sequence set forth in SEQ ID NO:205, or a conservatively substituted amino acid sequence thereof. In some embodiments, the PMK polypeptide encoded by the one or more heterologous nucleic acids is an ERG8 polypeptide and comprises an amino acid sequence having at least 50%, at least 55%, at least 60%, at least 65%, at least 70%, or at least 75% amino acid sequence identity to SEQ ID NO:205. In some embodiments, the PMK polypeptide encoded by the one or more heterologous nucleic acids is an ERG8 polypeptide and comprises an amino acid sequence having at least 80%, at least 81%, at least 82%, at least 83%, or at least 84% amino acid sequence identity to SEQ ID NO:205. In some embodiments, the PMK polypeptide encoded by the one or more heterologous nucleic acids is an ERG8 polypeptide and comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:205.

In some embodiments, a PMK polypeptide and MK polypeptide are fused into a single polypeptide chain (a PMK/MK fusion polypeptide). In some embodiments, the PMK/MK polypeptide encoded by the one or more heterologous nucleic acids comprises the amino acid sequence set forth in SEQ ID NO:68. In some embodiments, the PMK/MK polypeptide encoded by the one or more heterologous nucleic acids comprises the amino acid sequence set forth in SEQ ID NO:68, or a conservatively substituted amino acid sequence thereof. In some embodiments, the PMK/MK polypeptide encoded by the one or more heterologous nucleic acids comprises an amino acid sequence having at least 50%, at least 55%, at least 60%, at least 65%, at least 70%, or at least 75% amino acid sequence identity to SEQ ID NO:68. In some embodiments, the PMK/MK polypeptide encoded by the one or more heterologous nucleic acids comprises an amino acid sequence having at least 80%, at least 81%, at least 82%, at least 83%, or at least 84% amino acid sequence identity to SEQ ID NO:68. In some embodiments, the PMK/MK polypeptide encoded by the one or more heterologous nucleic acids comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:68. In some embodiments, the PMK/MK polypeptide encoded by the one or more heterologous nucleic acids comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:68.

In some embodiments, the MVD polypeptide encoded by the one or more heterologous nucleic acids is an ERG19 polypeptide and comprises the amino acid sequence set forth in SEQ ID NO:66. In some embodiments, the MVD polypeptide encoded by the one or more heterologous nucleic acids is an ERG19 polypeptide and comprises the amino acid sequence set forth in SEQ ID NO:66, or a conservatively substituted amino acid sequence thereof. In some embodiments, the MVD polypeptide encoded by the one or more heterologous nucleic acids is an ERG19 polypeptide and comprises an amino acid sequence having at least 50%, at least 55%, at least 60%, at least 65%, at least 70%, or at least 75% amino acid sequence identity to SEQ ID NO:66. In some embodiments, the MVD polypeptide encoded by the one or more heterologous nucleic acids is an ERG19 polypeptide and comprises an amino acid sequence having at least 80%, at least 81%, at least 82%, at least 83%, or at least 84% amino acid sequence identity to SEQ ID NO:66. In some embodiments, the MVD polypeptide encoded by the one or more heterologous nucleic acids is an ERG19 polypeptide and comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:66. In some embodiments, the MVD polypeptide encoded by the one or more heterologous nucleic acids is an ERG19 polypeptide and comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:66.

In some embodiments, the IDI1 polypeptide encoded by the one or more heterologous nucleic acids comprises the amino acid sequence set forth in SEQ ID NO:58. In some embodiments, the IDI1 polypeptide encoded by the one or more heterologous nucleic acids comprises the amino acid sequence set forth in SEQ ID NO:58, or a conservatively substituted amino acid sequence thereof. In some embodiments, the IDI1 polypeptide encoded by the one or more heterologous nucleic acids comprises an amino acid sequence having at least 50%, at least 55%, at least 60%, at least 65%, at least 70%, or at least 75% amino acid sequence identity to SEQ ID NO:58. In some embodiments, the IDI1 polypeptide encoded by the one or more heterologous nucleic acids comprises an amino acid sequence having at least 80%, at least 81%, at least 82%, at least 83%, or at least 84% amino acid sequence identity to SEQ ID NO:58. In some embodiments, the IDI1 polypeptide encoded by the one or more heterologous nucleic acids comprises an amino acid sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:58. In some embodiments, the IDI1 polypeptide encoded by the one or more heterologous nucleic acids comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:58.

Exemplary MEV pathway heterologous nucleic acids disclosed herein may include nucleic acids that encode a MEV pathway polypeptide, such as, a full-length MEV pathway polypeptide, a fragment of a MEV pathway polypeptide, a variant of a MEV pathway polypeptide, a truncated MEV pathway polypeptide, or a fusion polypeptide that has at least one activity of a polypeptide that is part of the MEV pathway.

In some embodiments, the MEV pathway polypeptide is overexpressed in the genetically modified host cell. Overexpression may be achieved by increasing the copy number of a MEV pathway polypeptide-encoding heterologous nucleic acid, e.g., through use of a high copy number expression vector (e.g., a plasmid that exists at 10-40 copies per cell) and/or by operably linking the MEV pathway polypeptide-encoding heterologous nucleic acid to a strong promoter. In some embodiments, the genetically modified host cell has one copy of a MEV pathway polypeptide-encoding heterologous nucleic acid. In some embodiments, the genetically modified host cell has two copies of a MEV pathway polypeptide-encoding heterologous nucleic acid. In some embodiments, the genetically modified host cell has three copies of a MEV pathway polypeptide-encoding heterologous nucleic acid. In some embodiments, the genetically modified host cell has four copies of a MEV pathway polypeptide-encoding heterologous nucleic acid. In some embodiments, the genetically modified host cell has five copies of a MEV pathway polypeptide-encoding heterologous nucleic acid.

In some embodiments, the one or more heterologous nucleic acids encoding a HMGS (mvaS) polypeptide comprise the nucleotide sequence set forth in SEQ ID NO:55. In some embodiments, the one or more heterologous nucleic acids encoding a HMGS (mvaS) polypeptide comprise the nucleotide sequence set forth in SEQ ID NO:55, or a codon degenerate nucleotide sequence thereof. In some embodiments, the one or more heterologous nucleic acids encoding a HMGS (mvaS) polypeptide comprise a nucleotide sequence having at least 80%, at least 81%, at least 82%, at least 83%, or at least 84% sequence identity to SEQ ID NO:55. In some embodiments, the one or more heterologous nucleic acids encoding a HMGS (mvaS) polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:55.

In some embodiments, the one or more heterologous nucleic acids encoding a HMGS (ERG13) polypeptide comprise the nucleotide sequence set forth in SEQ ID NO:116 or SEQ ID NO:120. In some embodiments, the one or more heterologous nucleic acids encoding a HMS (ERG13) polypeptide comprise the nucleotide sequence set forth in SEQ ID NO:116 or SEQ ID NO:120, or a codon degenerate nucleotide sequence thereof. In some embodiments, the one or more heterologous nucleic acids encoding a HMGS (ERG13) polypeptide comprise a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:116 or SEQ ID NO:120.

In some embodiments, the one or more heterologous nucleic acids encoding a HMGS (ERG13) polypeptide comprise the nucleotide sequence set forth in SEQ ID NO:116. In some embodiments, the one or more heterologous nucleic acids encoding a (ERG13) polypeptide comprise the nucleotide sequence set forth in SEQ ID NO:116, or a codon degenerate nucleotide sequence thereof. In some embodiments, the one or more heterologous nucleic acids encoding a HMGS (ERG13) polypeptide comprise a nucleotide sequence having at least 80%, at least 81%, at least 82%, at least 83%, or at least 84% sequence identity to SEQ ID NO:116. In some embodiments, the one or more heterologous nucleic acids encoding a HMGS (ERG13) polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:116.

In some embodiments, the one or more heterologous nucleic acids encoding a HMGS (ERG13) polypeptide comprise the nucleotide sequence set forth in SEQ ID NO:120. In some embodiments, the one or more heterologous nucleic acids encoding a HMGS (ERG13) polypeptide comprise the nucleotide sequence set forth in SEQ ID NO:120, or a codon degenerate nucleotide sequence thereof. In some embodiments, the one or more heterologous nucleic acids encoding a HMGS (ERG13) polypeptide comprise a nucleotide sequence having at least 80%, at least 81%, at least 82%, at least 83%, or at least 84% sequence identity to SEQ ID NO:120. In some embodiments, the one or more heterologous nucleic acids encoding a HMGS (ERG13) polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:120.

In some embodiments, the one or more heterologous nucleic acids encoding an HMGR (mvaE) polypeptide comprise the nucleotide sequence set forth in SEQ ID NO:53. In some embodiments, the one or more heterologous nucleic acids encoding an HMGR (mvaE) polypeptide comprise the nucleotide sequence set forth in SEQ ID NO:53, or a codon degenerate nucleotide sequence thereof. In some embodiments, the one or more heterologous nucleic acids encoding an HMGR (mvaE) polypeptide comprise a nucleotide sequence having at least 80%, at least 81%, at least 82%, at least 83%, or at least 84% sequence identity to SEQ ID NO:53. In some embodiments, the one or more heterologous nucleic acids encoding an HMGR (mvaE) polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:53.

In some embodiments, the one or more heterologous nucleic acids encoding a tHMGR polypeptide comprise the nucleotide sequence set forth in SEQ ID NO:51, SEQ ID NO:114, or SEQ ID NO:119. In some embodiments, the one or more heterologous nucleic acids encoding a tHMGR polypeptide comprise the nucleotide sequence set forth in SEQ ID NO:51, SEQ ID NO:114, or SEQ ID NO:119, or a codon degenerate nucleotide sequence thereof. In some embodiments, the one or more heterologous nucleic acids encoding a tHMGR polypeptide comprise a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:51, SEQ ID NO:114, or SEQ ID NO:119.

In some embodiments, the one or more heterologous nucleic acids encoding a tHMGR polypeptide comprise the nucleotide sequence set forth in SEQ ID NO:51. In some embodiments, the one or more heterologous nucleic acids encoding a tHMGR polypeptide comprise the nucleotide sequence set forth in SEQ ID NO:51, or a codon degenerate nucleotide sequence thereof. In some embodiments, the one or more heterologous nucleic acids encoding a tHMGR polypeptide comprise a nucleotide sequence having at least 80%, at least 81%, at least 82%, at least 83%, or at least 84% sequence identity to SEQ ID NO:51. In some embodiments, the one or more heterologous nucleic acids encoding a tHMGR polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:51.

In some embodiments, the one or more heterologous nucleic acids encoding a tHMGR polypeptide comprise the nucleotide sequence set forth in SEQ ID NO:114. In some embodiments, the one or more heterologous nucleic acids encoding a tHMGR polypeptide comprise the nucleotide sequence set forth in SEQ ID NO:114, or a codon degenerate nucleotide sequence thereof. In some embodiments, the one or more heterologous nucleic acids encoding a tHMGR polypeptide comprise a nucleotide sequence having at least 80%, at least 81%, at least 82%, at least 83%, or at least 84% sequence identity to SEQ ID NO:114. In some embodiments, the one or more heterologous nucleic acids encoding a tHMGR polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:114.

In some embodiments, the one or more heterologous nucleic acids encoding a tHMGR polypeptide comprise the nucleotide sequence set forth in SEQ ID NO:119. In some embodiments, the one or more heterologous nucleic acids encoding a tHMGR polypeptide comprise the nucleotide sequence set forth in SEQ ID NO:119, or a codon degenerate nucleotide sequence thereof. In some embodiments, the one or more heterologous nucleic acids encoding a tHMGR polypeptide comprise a nucleotide sequence having at least 80%, at least 81%, at least 82%, at least 83%, or at least 84% sequence identity to SEQ ID NO:119. In some embodiments, the one or more heterologous nucleic acids encoding a tHMGR polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:119.

In some embodiments, a genetically modified host cell of the present disclosure is genetically modified with two or more heterologous nucleic acids that encode a tHMGR polypeptide. In some embodiments, a genetically modified host cell of the present disclosure is genetically modified with two heterologous nucleic acids that encode a tHMGR polypeptide. In some embodiments, a genetically modified host cell of the present disclosure is genetically modified with two or more heterologous nucleic acids that encode an HMGR polypeptide. In some embodiments, a genetically modified host cell of the present disclosure is genetically modified with two heterologous nucleic acids that encode an HMGR polypeptide.

In some embodiments, the one or more heterologous nucleic acids encoding an MK (ERG12) polypeptide comprise the nucleotide sequence set forth in SEQ ID NO:63 or SEQ ID NO:206. In some embodiments, the one or more heterologous nucleic acids encoding an MK (ERG12) polypeptide comprise the nucleotide sequence set forth in SEQ ID NO:63 or SEQ ID NO:206, or a codon degenerate nucleotide sequence thereof. In some embodiments, the one or more heterologous nucleic acids encoding an MK (ERG12) polypeptide comprise a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:63 or SEQ ID NO:206.

In some embodiments, the one or more heterologous nucleic acids encoding an MK (ERG12) polypeptide comprise the nucleotide sequence set forth in SEQ ID NO:63. In some embodiments, the one or more heterologous nucleic acids encoding an MK (ERG12) polypeptide comprise the nucleotide sequence set forth in SEQ ID NO:63, or a codon degenerate nucleotide sequence thereof. In some embodiments, the one or more heterologous nucleic acids encoding an MK (ERG12) polypeptide comprise a nucleotide sequence having at least 80%, at least 81%, at least 82%, at least 83%, or at least 84% sequence identity to SEQ ID NO:63. In some embodiments, the one or more heterologous nucleic acids encoding an MK (ERG12) polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:63.

In some embodiments, the one or more heterologous nucleic acids encoding an MK (ERG12) polypeptide comprise the nucleotide sequence set forth in SEQ ID NO:206. In some embodiments, the one or more heterologous nucleic acids encoding an MK (ERG12) polypeptide comprise the nucleotide sequence set forth in SEQ ID NO:206, or a codon degenerate nucleotide sequence thereof. In some embodiments, the one or more heterologous nucleic acids encoding an MK (ERG12) polypeptide comprise a nucleotide sequence having at least 80%, at least 81%, at least 82%, at least 83%, or at least 84% sequence identity to SEQ ID NO:206, In some embodiments, the one or more heterologous nucleic acids encoding an MK (ERG12) polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:206.

In some embodiments, the one or more heterologous nucleic acids encoding a PMK (ERGS) polypeptide comprise the nucleotide sequence set forth in SEQ ID NO:61, SEQ ID NO:160, or SEQ ID NO:204. In some embodiments, the one or more heterologous nucleic acids encoding a PMK (ERG8) polypeptide comprise the nucleotide sequence set forth in SEQ ID NO:61, SEQ ID NO:160, or SEQ ID NO:204, or a codon degenerate nucleotide sequence thereof. In some embodiments, the one or more heterologous nucleic acids encoding a PMK (ERG8) polypeptide comprise a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:61, SEQ ID NO:160, or SEQ ID NO:204.

In some embodiments, the one or more heterologous nucleic acids encoding a PMK. (ERG8) polypeptide comprise the nucleotide sequence set forth in SEQ ID NO:61. In some embodiments, the one or more heterologous nucleic acids encoding a PMK (ERG8) polypeptide comprise the nucleotide sequence set forth in SEQ ID NO:61, or a codon degenerate nucleotide sequence thereof. In some embodiments, the one or more heterologous nucleic acids encoding a PMK (ERG8) polypeptide comprise a nucleotide sequence having at least 80%, at least 81%, at least 82%, at least 83%, or at least 84% sequence identity to SEQ ID NO:61. In some embodiments, the one or more heterologous nucleic acids encoding a PMK (ERG8) polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:61.

In some embodiments, the one or more heterologous nucleic acids encoding a PMK (ERG8) polypeptide comprise the nucleotide sequence set forth in SEQ ID NO:160. In some embodiments, the one or more heterologous nucleic acids encoding a PMK (ERG8) polypeptide comprise the nucleotide sequence set forth in SEQ ID NO:160, or a codon degenerate nucleotide sequence thereof. In some embodiments, the one or more heterologous nucleic acids encoding a PMK (ERG8) polypeptide comprise a nucleotide sequence having at least 80%, at least 81%, at least 82%, at least 83%, or at least 84% sequence identity to SEQ ID NO:160. In some embodiments, the one or more heterologous nucleic acids encoding a PMK (ERG8) polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:160.

In some embodiments, the one or more heterologous nucleic acids encoding a PMK (ERG8) polypeptide comprise the nucleotide sequence set forth in SEQ ID NO:204. In some embodiments, the one or more heterologous nucleic acids encoding a PMK (ERG8) polypeptide comprise the nucleotide sequence set forth in SEQ ID NO:204, or a codon degenerate nucleotide sequence thereof. In some embodiments, the one or more heterologous nucleic acids encoding a PMK (ERG8) polypeptide comprise a nucleotide sequence having at least 80%, at least 81%, at least 82%, at least 83%, or at least 84% sequence identity to SEQ ID NO:204. In some embodiments, the one or more heterologous nucleic acids encoding a PMK (ERG8) polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:204.

in some embodiments, the one or more heterologous nucleic acids encoding a PMK/MK polypeptide comprise the nucleotide sequence set forth in SEQ ID NO:67. In some embodiments, the one or more heterologous nucleic acids encoding a PMK/MK polypeptide comprise the nucleotide sequence set forth in SEQ ID NO:67, or a codon degenerate nucleotide sequence thereof. In some embodiments, the one or more heterologous nucleic acids encoding a PMK/MK polypeptide comprise a nucleotide sequence having at least 80%, at least 81%, at least 82%, at least 83%, or at least 84% sequence identity to SEQ ID NO:67. In some embodiments, the one or more heterologous nucleic acids encoding a PMK/MK polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:67. In some embodiments, the one or more heterologous nucleic acids encoding a PMK/MK polypeptide comprise a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:67.

In some embodiments, the one or more heterologous nucleic acids encoding an MVD (ERG19) polypeptide comprise the nucleotide sequence set forth in SEQ ID NO:65 or SEQ ID NO:158. In some embodiments, the one or more heterologous nucleic acids encoding an MVD (ERG19) polypeptide comprise the nucleotide sequence set forth in SEQ ID NO:65 or SEQ ID NO:158, or a codon degenerate nucleotide sequence thereof. In some embodiments, the one or more heterologous nucleic acids encoding an MVD (ERG19) polypeptide comprise a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:65 or SEQ ID NO:158.

In some embodiments, the one or more heterologous nucleic acids encoding an MVD (ERG19) polypeptide comprise the nucleotide sequence set forth in SEQ ID NO:65. In some embodiments, the one or more heterologous nucleic acids encoding an MVD (ERG19) polypeptide comprise the nucleotide sequence set forth in SEQ ID NO:65, or a codon degenerate nucleotide sequence thereof. In some embodiments, the one or more heterologous nucleic acids encoding an MVD (ERG19) polypeptide comprise a nucleotide sequence having at least 80%, at least 81%, at least 82%, at least 83%, or at least 84% sequence identity to SEQ ID NO:65. In some embodiments, the one or more heterologous nucleic acids encoding an MVD (ERG19) polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:65.

In some embodiments, the one or more heterologous nucleic acids encoding an MVD (ERG19) polypeptide comprise the nucleotide sequence set forth in SEQ ID NO:158. In some embodiments, the one or more heterologous nucleic acids encoding an MVD (ERG19) polypeptide comprise the nucleotide sequence set forth in SEQ ID NO:158, or a codon degenerate nucleotide sequence thereof. In some embodiments, the one or more heterologous nucleic acids encoding an MVD (ERG19) polypeptide comprise a nucleotide sequence having at least 80%, at least 81%, at least 82%, at least 83%, or at least 84% sequence identity to SEQ ID NO:158. In some embodiments, the one or more heterologous nucleic acids encoding an MVD (ERG19) polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:158.

In some embodiments, the one or more heterologous nucleic acids encoding an IDI1 polypeptide comprise the nucleotide sequence set forth in SEQ ID NO:57 or SEQ ID NO:159. In some embodiments, the one or more heterologous nucleic acids encoding an IDI1 polypeptide comprise the nucleotide sequence set forth in SEQ ID NO:57 or SEQ ID NO:159, or a codon degenerate nucleotide sequence thereof. In some embodiments, the one or more heterologous nucleic acids encoding an IDI1 polypeptide comprise a nucleotide sequence having at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:57 or SEQ ID NO:159.

In some embodiments, the one or more heterologous nucleic acids encoding an IDI1 polypeptide comprise the nucleotide sequence set forth in SEQ ID NO:57. In some embodiments, the one or more heterologous nucleic acids encoding an IDI1 polypeptide comprise the nucleotide sequence set forth in SEQ ID NO:57, or a codon degenerate nucleotide sequence thereof. In some embodiments, the one or more heterologous nucleic acids encoding an IDI1 polypeptide comprise a nucleotide sequence having at least 80%, at least 81%, at least 82%, at least 83%, or at least 84% sequence identity to SEQ ID NO:57. In some embodiments, the one or more heterologous nucleic acids encoding an IDI1 polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:57.

In some embodiments, the one or more heterologous nucleic acids encoding an IDI1 polypeptide comprise the nucleotide sequence set forth in SEQ ID NO:159. In some embodiments, the one or more heterologous nucleic acids encoding an IDI1 polypeptide comprise the nucleotide sequence set forth in SEQ ID NO:159, or a codon degenerate nucleotide sequence thereof. In some embodiments, the one or more heterologous nucleic acids encoding an IDI1 polypeptide comprise a nucleotide sequence having at least 80%, at least 81%, at least 82%, at least 83%, or at least 84% sequence identity to SEQ ID NO:159. In some embodiments, the one or more heterologous nucleic acids encoding an IDI1 polypeptide comprise a nucleotide sequence having at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% sequence identity to SEQ ID NO:159.

Polypeptides that Modulate NADH or NADPH Redox Balance, Nucleic Acids Comprising Said Polypeptides, and Genetically Modified Host Cells Expressing Said Polypeptides In some embodiments, the host cell is genetically modified with one or more heterologous nucleic acids encoding a polypeptide that modulates NADH or NADPH redox balance. GPP production has a redox imbalance in it that can be modulated by changing NADPH-using enzymes to NADH-using enzymes, bringing redox into better balance.

In some embodiments, a genetically modified host cell of the present disclosure is genetically modified with one or more heterologous nucleic acids encoding a polypeptide that modulates NADH or NADPH redox balance. In some embodiments, a genetically modified host cell of the present disclosure is genetically modified with one or more heterologous nucleic acids encoding more than one polypeptide that modulates NADH or NADPH redox balance. In some embodiments, a genetically modified host cell of the present disclosure is genetically modified with one or more heterologous nucleic acids encoding more than two polypeptides that modulate NADH or NADPH redox balance. In some embodiments, a genetically modified host cell of the present disclosure is genetically modified with one or more heterologous nucleic acids encoding more than three polypeptides that modulate NADH or NADPH redox balance. In some embodiments, a genetically modified host cell of the present disclosure is genetically modified with one or more heterologous nucleic acids encoding two polypeptides that modulate NADH or NADPH redox balance. In some embodiments, a genetically modified host cell of the present disclosure is genetically modified with one or more heterologous nucleic acids encoding three polypeptides that modulate NADH or NADPH redox balance. In some embodiments, a genetically modified host cell of the present disclosure is genetically modified with one or more heterologous nucleic acids encoding 1, 2, 3, or more polypeptides that modulate NADH or NADPH redox balance. In some embodiments, a genetically modified host cell of the present disclosure is genetically modified with one or more heterologous nucleic acids encoding 1, 2, or 3 polypeptides that modulate NADH or NADPH redox balance.

Exemplary polypeptides that modulate NADH or NADPH redox balance disclosed herein may include a full-length polypeptide that modulates NADH or NADPH redox balance, a fragment of a polypeptide that modulates NADH or NADPH redox balance, a variant of a polypeptide that modulates NADH or NADPH redox balance, a truncated polypeptide that modulates NADH or NADPH redox balance, or a fusion polypeptide that has at least one activity of a polypeptide that modulates NADH or NADPH redox balance.

Exemplary heterologous nucleic acids disclosed herein may include nucleic acids that encode a polypeptide that modulates NADH or NADPH redox balance, such as, a full-length polypeptide that modulates NADH or NADPH redox balance, a fragment of a polypeptide that modulates NADH or NADPH redox balance, a variant of a polypeptide that modulates NADH or NADPH redox balance, a truncated polypeptide that modulates NADH or NADPH redox balance, or a fusion polypeptide that has at least one activity of a polypeptide that modulates NADH or NADPH redox balance.

In some embodiments, the polypeptide that modulates NADH or NADPH redox balance is overexpressed in the genetically modified host cell. Overexpression may be achieved by increasing the copy number of the heterologous nucleic acid encoding a polypeptide that modulates NADH or NADPH redox balance, e.g., through use of a high copy number expression vector (e.g., a plasmid that exists at 10-40 copies per cell) and/or by operably linking the polypeptide that modulates NADH or NADPH redox balance encoding heterologous nucleic acid to a strong promoter. In some embodiments, the genetically modified host cell has one copy of a heterologous nucleic acid encoding a polypeptide that modulates NADH or NADPH redox balance. In some embodiments, the genetically modified host cell has two copies of a heterologous nucleic acid encoding a polypeptide that modulates NADH or NADPH redox balance. In some embodiments, the genetically modified host cell has three copies of a heterologous nucleic acid encoding a polypeptide that modulates NADH or NADPH redox balance. In some embodiments, the genetically modified host cell has four copies of a heterologous nucleic acid encoding a polypeptide that modulates NADH or NADPH redox balance. In some embodiments, the genetically modified host cell has five copies of a heterologous nucleic acid encoding a polypeptide that modulates NADH or NADPH redox balance.

DXP Pathway Polypeptides, Nucleic Acids Comprising Said Polypeptides, and Genetically Modified Host Cells Expressing Said Polypeptides In some embodiments, a genetically modified host cell of the present disclosure is genetically modified with one or more heterologous nucleic acids encoding one or more polypeptides having at least one activity of a polypeptide present in the deoxyxylulose-5-phosphate (DXP) pathway.

In some embodiments, the one or more polypeptides that generate GPP or are part of a biosynthetic pathway that generates GPP are polypeptides of the DXP pathway. The term "1-deoxy-D-xylulose 5-diphosphate pathway" or "DXP pathway" as used herein may refer to the pathway that converts glyceraldehyde-3-phosphate and pyruvate to IPP and DMAPP through a DXP pathway intermediate.

In the DXP pathway, pyruvate and D-glyceraldehyde-3-phosphate are converted via a series of reactions to IPP and DMAPP. The pathway involves action of the following polypeptides: a 1-deoxy-D-xylulose-5-phosphate synthase (Dxs) polypeptide, a 1-deoxy-D-xylulose-5-phosphate reductoisomerase (IspC) polypeptide, a 4-diphosphocytidyl-2-C-methyl-D-erythritol synthase (IspD) polypeptide, a 4-diphosphocytidyl-2-C-methyl-D-erythritol kinase (IspE) polypeptide, a 2C-methyl-D-erythritol 2,4-cyclodiphosphate synthase (IspF) polypeptide, a 1-hydroxy-2-methyl-2-(E)-butenyl 4-diphosphate synthase (IspG) polypeptide, and an isopentenyl diphosphate isomerase (IspH) polypeptide.

In some embodiments, a genetically modified host cell of the present disclosure is genetically modified with one or more heterologous nucleic acids encoding a DXP pathway polypeptide. In some embodiments, a genetically modified host cell of the present disclosure is genetically modified with one or more heterologous nucleic acids encoding more than one DXP pathway polypeptide. In some embodiments, a genetically modified host cell of the present disclosure is genetically modified with one or more heterologous nucleic acids encoding more than two DXP pathway polypeptides. In some embodiments, a genetically modified host cell of the present disclosure is genetically modified with one or more heterologous nucleic acids encoding more than three DXP pathway polypeptides. In some embodiments, a genetically modified host cell of the present disclosure is genetically modified with one or more heterologous nucleic acids encoding more than four DXP pathway polypeptides. In some embodiments, a genetically modified host cell of the present disclosure is genetically modified with one or more heterologous nucleic acids encoding more than five DXP pathway polypeptides. In some embodiments, a genetically modified host cell of the present disclosure is genetically modified with one or more heterologous nucleic acids encoding more than six DXP pathway polypeptides. In some embodiments, a genetically modified host cell of the present disclosure is genetically modified with one or more heterologous nucleic acids encoding all DXP pathway polypeptides.

In some embodiments, a genetically modified host cell of the present disclosure is genetically modified with one or more heterologous nucleic acids encoding two DXP pathway polypeptides. In some embodiments, a genetically modified host cell of the present disclosure is genetically modified with one or more heterologous nucleic acids encoding three DXP pathway polypeptides. In some embodiments, a genetically modified host cell of the present disclosure is genetically modified with one or more heterologous nucleic acids encoding four DXP pathway polypeptides. In some embodiments, a genetically modified host cell of the present disclosure is genetically modified with one or more heterologous nucleic acids encoding five DXP pathway polypeptides. In some embodiments, a genetically modified host cell of the present disclosure is genetically modified with one or more heterologous nucleic acids encoding six DXP pathway polypeptides. In some embodiments, a genetically modified host cell of the present disclosure is genetically modified with one or more heterologous nucleic acids encoding 1, 2, 3, 4, 5, 6, or more DXP pathway polypeptides. In some embodiments, a genetically modified host cell of the present disclosure is genetically modified with one or more heterologous nucleic acids encoding 1, 2, 3, 4, 5, or 6 DXP pathway polypeptides.

Exemplary polypeptides disclosed herein that are part of the DXP pathway may include a full-length DXP pathway polypeptide, a fragment of a DXP pathway polypeptide, a variant of a DXP pathway polypeptide, a truncated DXP pathway polypeptide, or a fusion polypeptide that has at least one activity of a polypeptide that is part of the DXP pathway.

Examples of polypeptides of the DXP pathway are set forth in SEQ ID NO:32, SEQ ID NO:33, SEQ ID NO:34, SEQ ID NO:35, SEQ ID NO:36, SEQ ID NO:37, SEQ ID NO:38, SEQ ID NO:39, SEQ ID NO:40.

In some embodiments, the 1-deoxy-D-xylulose-5-phosphate synthase (Dxs) polypeptide encoded by the one or more heterologous nucleic acids comprises the amino acid sequence set forth in SEQ ID NO:32. In some embodiments, the 1-deoxy-D-xylulose-5-phosphate synthase (Dxs) polypeptide encoded by the one or more heterologous nucleic acids comprises the amino acid sequence set forth in SEQ ID NO:32, or a conservatively substituted amino acid sequence thereof. In some embodiments, the 1-deoxy-D-xylulose-5-phosphate synthase (Dxs) polypeptide encoded by the one or more heterologous nucleic acids comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:32.

In some embodiments, the 1-deoxy-D-xylulose 5-phosphate reductoisomerase polypeptide encoded by the one or more heterologous nucleic acids comprises the amino acid sequence set forth in SEQ ID NO:33. In some embodiments, the 1-deoxy-D-xylulose 5-phosphate reductoisomerase polypeptide encoded by the one or more heterologous nucleic acids comprises the amino acid sequence set forth in SEQ ID NO:33, or a conservatively substituted amino acid sequence thereof. In some embodiments, the 1-deoxy-D- xylulose 5-phosphate reductoisomerase polypeptide encoded by the one or more heterologous nucleic acids comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:33.

In some embodiments, the 2-C-methyl-D-erythritol 4-phosphate cytidylyltransferase polypeptide encoded by the one or more heterologous nucleic acids comprises the amino acid sequence set forth in SEQ ID NO:34. In some embodiments, the 2-C-methyl-D-erythritol 4-phosphate cytidylyltransferase polypeptide encoded by the one or more heterologous nucleic acids comprises the amino acid sequence set forth in SEQ ID NO:34, or a conservatively substituted amino acid sequence thereof. In some embodiments, the 2-C-methyl-D-erythritol 4-phosphate cytidylyltransferase polypeptide encoded by the one or more heterologous nucleic acids comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:34.

In some embodiments, the 4-diphosphocytidyl-2-C-methylerythritol kinase polypeptide encoded by the one or more heterologous nucleic acids comprises the amino acid sequence set forth in SEQ ID NO:35. In some embodiments, the 4-diphosphocytidyl-2-C-methylerythritol kinase polypeptide encoded by the one or more heterologous nucleic acids comprises the amino acid sequence set forth in SEQ ID NO:35, or a conservatively substituted amino acid sequence thereof. In some embodiments, the 4-diphosphocytidyl-2-C-methylerythritol kinase polypeptide encoded by the one or more heterologous nucleic acids comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:35.

In some embodiments, the 2C-methyl-D-erythritol 2,4-cyclodiphosphate synthase polypeptide encoded by the one or more heterologous nucleic acids comprises the amino acid sequence set forth in SEQ ID NO:36. In some embodiments, the 2C-methyl-D-erythritol 2,4-cyclodiphosphate synthase polypeptide encoded by the one or more heterologous nucleic acids comprises the amino acid sequence set forth in SEQ ID NO:36, or a conservatively substituted amino acid sequence thereof. In some embodiments, the 2C-methyl-D-erythritol 2,4-cyclodiphosphate synthase polypeptide encoded by the one or more heterologous nucleic acids comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:36.

In some embodiments, the 4-hydroxy-3-methylbut-2-en-1-yl diphosphate synthase polypeptide encoded by the one or more heterologous nucleic acids comprises the amino acid sequence set forth in SEQ ID NO:37. In some embodiments, the 4-hydroxy-3-methylbut-2-en-1-yl diphosphate synthase polypeptide encoded by the one or more heterologous nucleic acids comprises the amino acid sequence set forth in SEQ ID NO:37, or a conservatively substituted amino acid sequence thereof. In some embodiments, the 4-hydroxy-3-methylbut-2-en-1-yl diphosphate synthase polypeptide encoded by the one or more heterologous nucleic acids comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:37.

In some embodiments, the 4-hydroxy-3-methylbut-2-enyl diphosphate reductase polypeptide encoded by the one or more heterologous nucleic acids comprises the amino acid sequence set forth in SEQ ID NO:38. In some embodiments, the 4-hydroxy-3-methylbut-2-enyl diphosphate reductase polypeptide encoded by the one or more heterologous nucleic acids comprises the amino acid sequence set forth in SEQ ID NO:38, or a conservatively substituted amino acid sequence thereof. In some embodiments, the 4-hydroxy-3-methylbut-2-enyl diphosphate reductase polypeptide encoded by the one or more heterologous nucleic acids comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:38.

In some embodiments, the isopentenyl diphosphate (IPP) isomerase polypeptide encoded by the one or more heterologous nucleic acids comprises the amino acid sequence set forth in SEQ ID NO:39. In some embodiments, the isopentenyl diphosphate (IPP) isomerase polypeptide encoded by the one or more heterologous nucleic acids comprises the amino acid sequence set forth in SEQ ID NO:39, or a conservatively substituted amino acid sequence thereof. In some embodiments, the isopentenyl diphosphate (IPP) isomerase polypeptide encoded by the one or more heterologous nucleic acids comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:39.

In some embodiments, the DXP pathway polypeptide is a mutated FPP synthase polypeptide. In some embodiments, the mutated FPP synthase polypeptide encoded by the one or more heterologous nucleic acids comprises the amino acid sequence set forth in SEQ ID NO:40. In some embodiments, the mutated FPP synthase polypeptide encoded by the one or more heterologous nucleic acids comprises the amino acid sequence set forth in SEQ ID NO:40, or a conservatively substituted amino acid sequence thereof. In some embodiments, the mutated FPP synthase isomerase polypeptide encoded by the one or more heterologous nucleic acids comprises an amino acid sequence having at least 50%, at least 55%, at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:40.

Exemplary DXP pathway heterologous nucleic acids disclosed herein may include nucleic acids that encode a DXP pathway polypeptide, such as, a full-length DXP pathway polypeptide, a fragment of a DXP pathway polypeptide, a variant of a DXP pathway polypeptide, a truncated DXP pathway polypeptide, or a fusion polypeptide that has at least one activity of a polypeptide that is part of the DXP pathway.

In some embodiments, the DXP pathway polypeptide is overexpressed in the genetically modified host cell. Overexpression may be achieved by increasing the copy number of the DXP pathway polypeptide-encoding heterologous nucleic acid, e.g., through use of a high copy number expression vector (e.g., a plasmid that exists at 10-40 copies per cell) and/or by operably linking the DXP pathway polypeptide-encoding heterologous nucleic acid to a strong promoter. In some embodiments, the genetically modified host cell has one copy of a DXP pathway polypeptide-encoding heterologous nucleic acid. In some embodiments, the genetically modified host cell has two copies of a DXP pathway polypeptide-encoding heterologous nucleic acid. In some embodiments, the genetically modified host cell has three copies of a DXP pathway polypeptide-encoding heterologous nucleic acid. In some embodiments, the genetically modified host cell has four copies of a DXP pathway polypeptide-encoding heterologous nucleic acid. In some embodiments, the genetically modified host cell has five copies of a DXP pathway polypeptide-encoding heterologous nucleic acid.

Genetically Modified Host Cells to Generate Cannabinoids, Cannabinoid Derivatives, Cannabinoid Precursors, or Cannabinoid Precursor Derivatives The disclosure provides for genetically modified host cells for producing cannabinoids, cannabinoid derivatives, cannabinoid precursors, or cannabinoid precursor derivatives. For producing cannabinoids, cannabinoid derivatives, cannabinoid precursors, or cannabinoid precursor derivatives, genetically modified host cells disclosed herein may be genetically modified to express or overexpress one or more heterologous nucleic acids disclosed herein that encode one or more polypeptides disclosed herein. In some embodiments, the genetically modified host cell of the disclosure produces a cannabinoid or a cannabinoid derivative. The disclosure also provides genetically modified host cells genetically modified to express or overexpress one or more heterologous nucleic acids disclosed herein that encode one or more polypeptides disclosed herein.

In some embodiments, to produce cannabinoids, cannabinoid derivatives, cannabinoid precursors, or cannabinoid precursor derivatives, expression or overexpression of one or more heterologous nucleic acids disclosed herein that encode one or more polypeptides disclosed herein in a genetically modified host cell may be done in combination with expression or overexpression by the genetically modified host cell of one or more other heterologous nucleic acids disclosed herein that encode one or more polypeptides disclosed herein. In certain such embodiments, the genetically modified host cell produces a cannabinoid or a cannabinoid derivative.

Exemplary Genetically Modified Host Cells Expressing a GOT Polypeptide, Wherein Said GOT Polypeptide Can Catalyze Production of Cannabigerolic Acid from Geranyl Pyrophosphate and Olivetolic Acid in an Amount at Least Ten Times Higher than a Polypeptide Comprising an Amino Acid Sequence Set Forth in SEQ ID NO:82

Some embodiments of the disclosure relate to a genetically modified host cell for producing a cannabinoid or a cannabinoid derivative, the genetically modified host cell comprising one or more heterologous nucleic acids encoding a GOT polypeptide, wherein said GOT polypeptide can catalyze production of cannabigerolic acid from GPP and olivetolic acid in an amount at least ten times higher than a polypeptide comprising an amino acid sequence set forth in SEQ ID NO:82.

The disclosure also provides genetically modified host cells genetically modified to express or overexpress one or more heterologous nucleic acids encoding a GOT polypeptide, wherein said GOT polypeptide can catalyze production of cannabigerolic acid from GPP and olivetolic acid in an amount at least ten times higher than a polypeptide comprising an amino acid sequence set forth in SEQ ID NO:82.

In some embodiments, the genetically modified host cell comprising one or more heterologous nucleic acids encoding a GOT polypeptide, wherein said GOT polypeptide can catalyze production of cannabigerolic acid from GPP and olivetolic acid in an amount at least ten times higher than a polypeptide comprising an amino acid sequence set forth in SEQ ID NO:82, further comprises one or more heterologous nucleic acids encoding a TKS polypeptide and one or more heterologous nucleic acids encoding an OAC polypeptide. In certain such embodiments, the TKS polypeptide comprises an amino acid sequence having at least 50% sequence identity to SEQ ID NO:11 or SEQ ID NO:76, and the OAC polypeptide comprises an amino acid sequence having at least 50% sequence identity to SEQ ID NO:10 or SEQ ID NO:78.

In some embodiments, a genetically modified host cell comprising one or more heterologous nucleic acids encoding a GOT polypeptide, wherein said GOT polypeptide can catalyze production of cannabigerolic acid from GPP and olivetolic acid in an amount at least ten times higher than a polypeptide, comprising an amino acid sequence set forth in SEQ ID NO:82, further comprises one or more of the following: a) one or more heterologous nucleic acids encoding a polypeptide that generates an acyl-CoA compound or an acyl-CoA compound derivative; b) one or more heterologous nucleic acids encoding a polypeptide that generates GPP; or c) one or more heterologous nucleic acids encoding a polypeptide that generates malonyl-CoA. In certain such embodiments, the polypeptide that generates an acyl-CoA compound or an acyl-CoA compound derivative is an acyl-activating enzyme (AAE) polypeptide. In certain such embodiments, the AAE polypeptide comprises an amino acid sequence having at least 50% sequence identity to SEQ ID NO:90. In some embodiments, the AAE polypeptide comprises an amino acid sequence having at least 50% sequence identity to SEQ ID NO:92 or SEQ ID NO:149. In some embodiments, the polypeptide that generates an acyl-CoA compound or an acyl-CoA compound derivative is a fatty acyl-CoA ligase polypeptide. In certain such embodiments, the fatty acyl-CoA ligase polypeptide comprises an amino acid sequence having at least 50% sequence identity to SEQ ID NO:145 or SEQ ID NO:147. In some embodiments, the polypeptide that generates an acyl-CoA compound or an acyl-CoA compound derivative is a fatty acyl-CoA synthetase (FAA) polypeptide. In certain such embodiments, the FAA polypeptide comprises an amino acid sequence having at least 50% sequence identity to SEQ ID NO:169, SEQ ID NO:192, SEQ ID NO:194, SEQ ID NO:196, SEQ ID NO:198, or SEQ ID NO:200. In some embodiments, the polypeptide that generates GPP is a GPPS polypeptide. In certain such embodiments, the GPPS polypeptide comprises an amino acid sequence having at least 50% sequence identity to SEQ ID NO:7, SEQ ID NO:8, or SEQ ID NO:60. In some embodiments, the polypeptide that generates malonyl-CoA is an ACC polypeptide. In certain such embodiments, the ACC polypeptide comprises an amino acid sequence having at least 50% sequence identity to SEQ ID NO:9, SEQ ID NO:97, or SEQ ID NO:207.

In some embodiments, a genetically modified host cell comprising one or more heterologous nucleic acids encoding a GOT polypeptide, wherein said GOT polypeptide can catalyze production of cannabigerolic acid from GPP and olivetolic acid in an amount at least ten times higher than a polypeptide comprising an amino acid sequence set forth in SEQ ID NO:82, further comprises one or more of the following: a) one or more heterologous nucleic acids encoding a HMGS polypeptide; b) one or more heterologous nucleic acids encoding a 3-hydroxy-3-methyl-glutaryl-CoA reductase (HMGR) polypeptide; c) one or more heterologous nucleic acids encoding a MK polypeptide; d) a PMK polypeptide; e) one or more heterologous nucleic acids encoding a MVD polypeptide; or f) one or more heterologous nucleic acids encoding an IDI polypeptide. In certain such embodiments, the genetically modified host cell further comprises one or more heterologous nucleic acids encoding an IDI polypeptide. In certain such embodiments, the IDI polypeptide comprises an amino acid sequence having at least 50% sequence identity to SEQ ID NO:58. In some embodiments, the genetically modified host cell further comprises one or more heterologous nucleic acids encoding an HMGR polypeptide. In certain such embodiments, the HMGR polypeptide comprises an amino acid sequence having at least 50% sequence identity to SEQ ID NO:22. In some embodiments, the HMGR polypeptide is a truncated HMGR (tHMGR) polypeptide. In certain such embodiments, the tHMGR polypeptide comprises an amino acid sequence having at least 50% sequence identity to SEQ ID NO:17, SEQ ID NO:52, SEQ ID NO:113, or SEQ ID NO:208. In some embodiments, the genetically modified host cell further comprises one or more heterologous nucleic acids encoding an HMGS polypeptide. In certain such embodiments, the HMGS polypeptide comprises an amino acid sequence having at least 50% sequence identity to SEQ ID NO:23, SEQ ID NO:24, or SEQ ID NO:115. In some embodiments, the genetically modified host cell further comprises one or more heterologous nucleic acids encoding an MK polypeptide. In certain such embodiments, the MK polypeptide comprises an amino acid sequence having at least 50% sequence identity to SEQ ID NO:64. In some embodiments, the genetically modified host cell further comprises one or more heterologous nucleic acids encoding a PMK polypeptide. In certain such embodiments, the PMK polypeptide comprises an amino acid sequence having at least 50% sequence identity to SEQ ID NO:62 or SEQ ID NO:205. In some embodiments, the genetically modified host cell further comprises one or more heterologous nucleic acids encoding a MVD polypeptide. In certain such embodiments, the MVD polypeptide comprises an amino acid sequence having at least 50% sequence identity to SEQ ID NO:66.

In some embodiments, a genetically modified host cell comprising one or more heterologous nucleic acids encoding a GOT polypeptide, wherein said GOT polypeptide can catalyze production of cannabigerolic acid from GPP and olivetolic acid in an amount at least ten times higher than a polypeptide comprising an amino acid sequence set forth in SEQ ID NO:82, further comprises one or more heterologous nucleic acids encoding a polypeptide that condenses two molecules of acetyl-CoA to generate acetoacetyl-CoA. In certain such embodiments, the polypeptide that condenses two molecules of acetyl-CoA to generate acetoacetyl-CoA is an acetoacetyl-CoA thiolase polypeptide. In certain such embodiments, the acetoacetyl-CoA thiolase polypeptide comprises an amino acid sequence having at least 50% sequence identity to SEQ ID NO:25.

In some embodiments, a genetically modified host cell comprising one or more heterologous nucleic acids encoding a GOT polypeptide, wherein said GOT polypeptide can catalyze production of cannabigerolic acid from GPP and olivetolic acid in an amount at least ten times higher than a polypeptide comprising an amino acid sequence set forth in SEQ ID NO:82, further comprises one or more heterologous nucleic acids encoding a PDC polypeptide. In certain such embodiments, the PDC polypeptide comprises an amino acid sequence having at least 50% sequence identity to SEQ ID NO:117.

In some embodiments, a genetically modified host cell comprising one or more heterologous nucleic acids encoding a GOT polypeptide, wherein said GOT polypeptide can catalyze production of cannabigerolic acid from GPP and olivetolic acid in an amount at least ten times higher than a polypeptide comprising an amino acid sequence set forth in SEQ ID NO:82, further comprises one or more heterologous nucleic acids encoding a cannabinoid synthase polypeptide. In certain such embodiments, the cannabinoid synthase polypeptide is a THCA synthase polypeptide. In certain such embodiments, the THCA synthase polypeptide comprises an amino acid sequence having at least 50% sequence identity to SEQ ID NO:14, SEQ ID NO:86, SEQ ID NO:104, SEQ ID NO:153, or SEQ ID NO:155. In some embodiments, the cannabinoid synthase polypeptide is a CBDA synthase polypeptide. In certain such embodiments, the CBDA synthase polypeptide comprises an amino acid sequence having at least 50% sequence identity to SEQ ID NO:88 or SEQ ID NO:151.

Exemplary Genetically Modified Host Cells Expressing a Polypeptide Comprising an Amino Acid Sequence Having Sequence Identity to SEQ ID NO:110

Some embodiments of the disclosure relate to a genetically modified host cell for producing a cannabinoid or a cannabinoid derivative, the genetically modified host cell comprising one or more heterologous nucleic acids encoding a GOT polypeptide comprising an amino acid sequence having at least 65% sequence identity to SEQ ID NO:110. In certain such embodiments, the GOT polypeptide encoded by the one or more heterologous nucleic acids comprises an amino acid sequence having at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:110. In some embodiments, the GOT polypeptide encoded by the one or more heterologous nucleic acids comprises the amino acid sequence set forth in SEQ ID NO:110. In some embodiments, the GOT polypeptide encoded by the one or more heterologous nucleic acids comprises the amino acid sequence set forth in SEQ ID NO:110, or a conservatively substituted amino acid sequence thereof.

The disclosure also provides genetically modified host cells genetically modified to express or overexpress one or more heterologous nucleic acids encoding a GOT polypeptide comprising an amino acid sequence having at least 65% sequence identity to SEQ ID NO:110. In certain such embodiments, the GOT polypeptide encoded by the one or more heterologous nucleic acids comprises an amino acid sequence having at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:110. In some embodiments, the GOT polypeptide encoded by the one or more heterologous nucleic acids comprises the amino acid sequence set forth in SEQ ID NO:110. In some embodiments, the GOT polypeptide encoded by the one or more heterologous nucleic acids comprises the amino acid sequence set forth in SEQ ID NO:110, or a conservatively substituted amino acid sequence thereof.

In some embodiments, the genetically modified host cell comprising one or more heterologous nucleic acids encoding a GOT polypeptide comprising an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:110 further comprises one or more heterologous nucleic acids encoding a TKS polypeptide and one or more heterologous nucleic acids encoding an OAC polypeptide. In certain such embodiments, the TKS polypeptide comprises an amino acid sequence having at least 50% sequence identity to SEQ ID NO:11 or SEQ ID NO:76, and the OAC polypeptide comprises an amino acid sequence having at least 50% sequence identity to SEQ ID NO:10 or SEQ ID NO:78.

In some embodiments, a genetically modified host cell comprising one or more heterologous nucleic acids encoding a GOT polypeptide comprising an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:110 further comprises one or more of the following: a) one or more heterologous nucleic acids encoding a polypeptide that generates an acyl-CoA compound or an acyl-CoA compound derivative; b) one or more heterologous nucleic acids encoding a polypeptide that generates GPP; or c) one or more heterologous nucleic acids encoding a polypeptide that generates malonyl-CoA. In certain such embodiments, the polypeptide that generates an acyl-CoA compound or an acyl-CoA compound derivative is an acyl-activating enzyme (AAE) polypeptide. In certain such embodiments, the AAE polypeptide comprises an amino acid sequence having at least 50% sequence identity to SEQ ID NO:90. In some embodiments, the AAE polypeptide comprises an amino acid sequence having at least 50% sequence identity to SEQ ID NO:92 or SEQ ID NO:149. In some embodiments, the polypeptide that generates an acyl-CoA compound or an acyl-CoA compound derivative is a fatty acyl-CoA ligase polypeptide. In certain such embodiments, the fatty acyl-CoA ligase polypeptide comprises an amino acid sequence having at least 50% sequence identity to SEQ ID NO:145 or SEQ ID NO:147. In some embodiments, the polypeptide that generates an acyl-CoA compound or an acyl-CoA compound derivative is a fatty acyl-CoA synthetase (FAA) polypeptide. In certain such embodiments, the FAA polypeptide comprises an amino acid sequence having at least 50% sequence identity to SEQ ID NO:169, SEQ ID NO:192, SEQ ID NO:194, SEQ ID NO:196, SEQ ID NO:198, or SEQ ID NO:200. In some embodiments, the polypeptide that generates GPP is a GPPS polypeptide. In certain such embodiments, the GPPS polypeptide comprises an amino acid sequence having at least 50% sequence identity to SEQ ID NO:7, SEQ ID NO:8, or SEQ ID NO:60. In some embodiments, the polypeptide that generates malonyl-CoA is an ACC polypeptide. In certain such embodiments, the ACC polypeptide comprises an amino acid sequence having at least 50% sequence identity to SEQ ID NO:9, SEQ ID NO:97, or SEQ ID NO:207.

In some embodiments, a genetically modified host cell comprising one or more heterologous nucleic acids encoding a GOT polypeptide comprising an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:110 further comprises one or more of the following: a) one or more heterologous nucleic acids encoding a HMGS polypeptide; b) one or more heterologous nucleic acids encoding a 3-hydroxy-3-methyl-glutaryl-CoA reductase (HMGR) polypeptide; c) one or more heterologous nucleic acids encoding a MK polypeptide; d) one or more heterologous nucleic acids encoding a PMK polypeptide; e) one or more heterologous nucleic acids encoding a MVD polypeptide; or f) one or more heterologous nucleic acids encoding an IDI polypeptide. In certain such embodiments, the genetically modified host cell further comprises one or more heterologous nucleic acids encoding an IDI polypeptide. In certain such embodiments, the IDI polypeptide comprises an amino acid sequence having at least 50% sequence identity to SEQ ID NO:58. In some embodiments, the genetically modified host cell further comprises one or more heterologous nucleic acids encoding an HMGR polypeptide. In certain such embodiments, the HMGR polypeptide comprises an amino acid sequence having at least 50% sequence identity to SEQ ID NO:22. In some embodiments, the HMGR polypeptide is a truncated HMGR (tHMGR) polypeptide. In certain such embodiments, the tHMGR polypeptide comprises an amino acid sequence having at least 50% sequence identity to SEQ ID NO:17, SEQ ID NO:52, SEQ ID NO:113, or SEQ ID NO:208. In some embodiments, the genetically modified host cell further comprises one or more heterologous nucleic acids encoding an HMGS polypeptide. In certain such embodiments, the HMGS polypeptide comprises an amino acid sequence having at least 50% sequence identity to SEQ ID NO:23, SEQ ID NO:24, or SEQ ID NO:115. In some embodiments, the genetically modified host cell further comprises one or more heterologous nucleic acids encoding an MK polypeptide. In certain such embodiments, the MK polypeptide comprises an amino acid sequence having at least 50% sequence identity to SEQ ID NO:64. In some embodiments, the genetically modified host cell further comprises one or more heterologous nucleic acids encoding a PMK polypeptide. In certain such embodiments, the PMK polypeptide comprises an amino acid sequence having at least 50% sequence identity to SEQ ID NO:62 or SEQ ID NO:205. In some embodiments, the genetically modified host cell further comprises one or more heterologous nucleic acids encoding a MVD polypeptide. In certain such embodiments, the MVD polypeptide comprises an amino acid sequence having at least 50% sequence identity to SEQ ID NO:66.

In some embodiments, a genetically modified host cell comprising one or more heterologous nucleic acids encoding a GOT polypeptide comprising an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:110 further comprises one or more heterologous nucleic acids encoding a polypeptide that condenses two molecules of acetyl-CoA to generate acetoacetyl-CoA. In certain such embodiments, the polypeptide that condenses two molecules of acetyl-CoA to generate acetoacetyl-CoA is an acetoacetyl-CoA thiolase polypeptide. In certain such embodiments, the acetoacetyl-CoA thiolase polypeptide comprises an amino acid sequence having at least 50% sequence identity to SEQ ID NO:25.

In some embodiments, a genetically modified host cell comprising one or more heterologous nucleic acids encoding a GOT polypeptide comprising an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:110 further comprises one or more heterologous nucleic acids encoding a PDC polypeptide. In certain such embodiments, the PDC polypeptide comprises an amino acid sequence having at least 50% sequence identity to SEQ ID NO:117.

In some embodiments, a genetically modified host cell comprising one or more heterologous nucleic acids encoding a GOT polypeptide comprising an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:110 further comprises one or more heterologous nucleic acids encoding a cannabinoid synthase polypeptide. In certain such embodiments, the cannabinoid synthase polypeptide is a THCA synthase polypeptide. In certain such embodiments, the THCA synthase polypeptide comprises an amino acid sequence having at least 50% sequence identity to SEQ ID NO:14, SEQ ID NO:86, SEQ ID NO:104, SEQ ID NO:153, or SEQ ID NO:155. In some embodiments, the cannabinoid synthase polypeptide is a CBDA synthase polypeptide. In certain such embodiments, the CBDA synthase polypeptide comprises an amino acid sequence having at least 50% sequence identity to SEQ ID NO:88 or SEQ ID NO:151.

Exemplary Genetically Modified Host Cells Expressing a Polypeptide Comprising an Amino Acid Sequence Having Sequence Identity to SEQ ID NO:100

The disclosure provides a genetically modified host cell for producing a cannabinoid or a cannabinoid derivative, the genetically modified host cell comprising one or more heterologous nucleic acids encoding a GOT polypeptide comprising an amino acid sequence having at least 65% sequence identity to SEQ ID NO:100. In certain such embodiments, the GOT polypeptide encoded by the one or more heterologous nucleic acids comprises an amino acid sequence having at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:100. In some embodiments, the GOT polypeptide encoded by the one or more heterologous nucleic acids comprises the amino acid sequence set forth in SEQ ID NO:100. In some embodiments, the GOT polypeptide encoded by the one or more heterologous nucleic acids comprises the amino acid sequence set forth in SEQ ID NO:100, or a conservatively substituted amino acid sequence thereof.

The disclosure also provides genetically modified host cells genetically modified to express or overexpress one or more heterologous nucleic acids encoding GOT a polypeptide comprising an amino acid sequence having at least 65% sequence identity to SEQ ID NO:100. In certain such embodiments, the GOT polypeptide encoded by the one or more heterologous nucleic acids comprises an amino acid sequence having at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or 100% amino acid sequence identity to SEQ ID NO:100. In some embodiments, the GOT polypeptide encoded by the one or more heterologous nucleic acids comprises the amino acid sequence set forth in SEQ ID NO:100. In some embodiments, the GOT polypeptide encoded by the one or more heterologous nucleic acids comprises the amino acid sequence set forth in SEQ ID NO:100, or a conservatively substituted amino acid sequence thereof.

In some embodiments, the genetically modified host cell comprising one or more heterologous nucleic acids encoding a GOT polypeptide comprising an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:100 further comprises one or more heterologous nucleic acids encoding a TKS polypeptide and one or more heterologous nucleic acids encoding an OAC polypeptide. In certain such embodiments, the TKS polypeptide comprises an amino acid sequence having at least 50% sequence identity to SEQ ID NO:11 or SEQ ID NO:76, and the OAC polypeptide comprises an amino acid sequence having at least 50% sequence identity to SEQ ID NO:10 or SEQ ID NO:78.

In some embodiments, a genetically modified host cell comprising one or more heterologous nucleic acids encoding a GOT polypeptide comprising an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:100 further comprises one or more of the following: a) one or more heterologous nucleic acids encoding a polypeptide that generates an acyl-CoA compound or an acyl-CoA compound derivative; b) one or more heterologous nucleic acids encoding a polypeptide that generates GPP; or c) one or more heterologous nucleic acids encoding a polypeptide that generates malonyl-CoA. In certain such embodiments, the polypeptide that generates an acyl-CoA compound or an acyl-CoA compound derivative is an acyl-activating enzyme (AAE) polypeptide. In certain such embodiments, the AAE polypeptide comprises an amino acid sequence having at least 50% sequence identity to SEQ ID NO:90. In some embodiments, the AAE polypeptide comprises an amino acid sequence having at least 50% sequence identity to SEQ ID NO:92 or SEQ ID NO:149. In some embodiments, the polypeptide that generates an acyl-CoA compound or an acyl-CoA compound derivative is a fatty acyl-CoA ligase polypeptide. In certain such embodiments, the fatty acyl-CoA ligase polypeptide comprises an amino acid sequence having at least 50% sequence identity to SEQ ID NO:145 or SEQ ID NO:147. In some embodiments, the polypeptide that generates an acyl-CoA compound or an acyl-CoA compound derivative is a fatty acyl-CoA synthetase (FAA) polypeptide. In certain such embodiments, the FAA polypeptide comprises an amino acid sequence having at least 50% sequence identity to SEQ ID NO:169, SEQ ID NO:192, SEQ ID NO:194, SEQ ID NO:196, SEQ ID NO:198, or SEQ ID NO:200. In some embodiments, the polypeptide that generates GPP is a GPPS polypeptide. In certain such embodiments, the GPPS polypeptide comprises an amino acid sequence having at least 50% sequence identity to SEQ ID NO:7, SEQ ID NO:8, or SEQ ID NO:60. In some embodiments, the polypeptide that generates malonyl-CoA is an ACC polypeptide. In certain such embodiments, the ACC polypeptide comprises an amino acid sequence having at least 50% sequence identity to SEQ ID NO:9, SEQ ID NO:97, or SEQ ID NO:207.

In some embodiments, a genetically modified host cell comprising one or more heterologous nucleic acids encoding a GOT polypeptide comprising an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:100 further comprises one or more of the following: a) one or more heterologous nucleic acids encoding a HMGS polypeptide; b) one or more heterologous nucleic acids encoding a 3-hydroxy-3-methyl-glutaryl-CoA reductase (HMGR) polypeptide; c) one or more heterologous nucleic acids encoding a MK polypeptide; d) one or more heterologous nucleic acids encoding a PMK polypeptide; e) one or more heterologous nucleic acids encoding a MVD polypeptide; or f) one or more heterologous nucleic acids encoding an IDI polypeptide. In certain such embodiments, the genetically modified host cell further comprises one or more heterologous nucleic acids encoding an IDI polypeptide. In certain such embodiments, the IDI polypeptide comprises an amino acid sequence having at least 50% sequence identity to SEQ ID NO:58. In some embodiments, the genetically modified host cell further comprises one or more heterologous nucleic acids encoding an HMGR polypeptide. In certain such embodiments, the HMGR polypeptide comprises an amino acid sequence having at least 50% sequence identity to SEQ ID NO:22. In some embodiments, the HMGR polypeptide is a truncated HMGR (tHMGR) polypeptide. In certain such embodiments, the tHMGR polypeptide comprises an amino acid sequence having at least 50% sequence identity to SEQ ID NO:17, SEQ ID NO:52, SEQ ID NO:113, or SEQ ID NO:208. In some embodiments, the genetically modified host cell further comprises one or more heterologous nucleic acids encoding an HMGS polypeptide. In certain such embodiments, the HMGS polypeptide comprises an amino acid sequence having at least 50% sequence identity to SEQ ID NO:23, SEQ ID NO:24, or SEQ ID NO:115. In some embodiments, the genetically modified host cell further comprises one or more heterologous nucleic acids encoding an MK polypeptide.

In certain such embodiments, the MK polypeptide comprises an amino acid sequence having at least 50% sequence identity to SEQ ID NO:64. In some embodiments, the genetically modified host cell further comprises one or more heterologous nucleic acids encoding a PMK polypeptide. In certain such embodiments, the PMK polypeptide comprises an amino acid sequence having at least 50% sequence identity to SEQ ID NO:62 or SEQ ID NO:205. In some embodiments, the genetically modified host cell further comprises one or more heterologous nucleic acids encoding a MVD polypeptide. In certain such embodiments, the MVD polypeptide comprises an amino acid sequence having at least 50% sequence identity to SEQ ID NO:66.

In some embodiments, a genetically modified host cell comprising one or more heterologous nucleic acids encoding a GOT polypeptide comprising an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:100 further comprises one or more heterologous nucleic acids encoding a polypeptide that condenses two molecules of acetyl-CoA to generate acetoacetyl-CoA. In certain such embodiments, the polypeptide that condenses two molecules of acetyl-CoA to generate acetoacetyl-CoA is an acetoacetyl-CoA thiolase polypeptide. In certain such embodiments, the acetoacetyl-CoA thiolase polypeptide comprises an amino acid sequence having at least 50% sequence identity to SEQ ID NO:25.

In some embodiments, a genetically modified host cell comprising one or more heterologous nucleic acids encoding a GOT polypeptide comprising an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:100 further comprises one or more heterologous nucleic acids encoding a PDC polypeptide. In certain such embodiments, the PDC polypeptide comprises an amino acid sequence having at least 50% sequence identity to SEQ ID NO:117.

In some embodiments, a genetically modified host cell comprising one or more heterologous nucleic acids encoding a GOT polypeptide comprising an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:100 further comprises one or more heterologous nucleic acids encoding a cannabinoid synthase polypeptide. In certain such embodiments, the cannabinoid synthase polypeptide is a THCA synthase polypeptide. In certain such embodiments, the THCA synthase polypeptide comprises an amino acid sequence having at least 50% sequence identity to SEQ ID NO:14, SEQ ID NO:86, SEQ ID NO:104, SEQ ID NO:153, or SEQ ID NO:155. In some embodiments, the cannabinoid synthase polypeptide is a CBDA synthase polypeptide. In certain such embodiments, the CBDA synthase polypeptide comprises an amino acid sequence having at least 50% sequence identity to SEQ ID NO:88 or SEQ ID NO:151.

Exemplary Genetically Modified Host Cells Expressing GOT Polypeptides

The present disclosure provides a genetically modified host cell that produces a cannabinoid or a cannabinoid derivative, wherein the genetically modified host cell is genetically modified with: a) one or more heterologous nucleic acids that encode a GOT polypeptide and b) one or more heterologous nucleic acids that encode a THCA synthase polypeptide. In certain such embodiments, the GOT polypeptide can catalyze production of cannabigerolic acid from GPP and olivetolic acid in an amount at least ten times higher than a polypeptide comprising an amino acid sequence set forth in SEQ ID NO:82. In some embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:100 or SEQ ID NO:110. In certain such embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:110. In some embodiments, the THCA synthase polypeptide comprises an amino acid sequence having at least 50% sequence identity to SEQ ID NO:14, SEQ ID NO:86, SEQ ID NO:104, SEQ ID NO:153, or SEQ ID NO:155.

The present disclosure provides a genetically modified host cell that produces a cannabinoid or a cannabinoid derivative, wherein the genetically modified host cell is genetically modified with: a) one or more heterologous nucleic acids that encode a GOT polypeptide and b) one or more heterologous nucleic acids that encode a CBDA synthase polypeptide. In certain such embodiments, the GOT polypeptide can catalyze production of cannabigerolic acid from GPP and olivetolic acid in an amount at least ten times higher than a polypeptide comprising an amino acid sequence set forth in SEQ ID NO:82. In some embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:100 or SEQ ID NO:110. In certain such embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:110. In some embodiments, the CBDA synthase polypeptide comprises an amino acid sequence having at least 50% sequence identity to SEQ ID NO:88 or SEQ ID NO:151.

The present disclosure provides a genetically modified host cell for producing a cannabinoid or a cannabinoid derivative, wherein the genetically modified host cell is genetically modified with: a) one or more heterologous nucleic acids that encode a GOT polypeptide and b) one or more heterologous nucleic acids that encode a TKS polypeptide and one or more heterologous nucleic acids that encode an OAC polypeptide. In certain such embodiments, the GOT polypeptide can catalyze production of cannabigerolic acid from GPP and olivetolic acid in an amount at least ten times higher than a polypeptide comprising an amino acid sequence set forth in SEQ ID NO:82. In some embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:100 or SEQ ID NO:110. In certain such embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:110. In some embodiments, the TKS polypeptide comprises an amino acid sequence having at least 50% sequence identity to SEQ ID NO:11 or SEQ ID NO:76; and the OAC polypeptide comprises an amino acid sequence having at least 50% sequence identity to SEQ ID NO:10 or SEQ ID NO:78.

The present disclosure provides a genetically modified host cell for producing a cannabinoid or a cannabinoid derivative, wherein the genetically modified host cell is genetically modified with: a) one or more heterologous nucleic acids that encode a GOT polypeptide, b) one or more heterologous nucleic acids that encode a TKS polypeptide and one or more heterologous nucleic acids that encode an OAC polypeptide, and c) one or more heterologous nucleic acids that encode a MCA synthase polypeptide. In certain such embodiments, the GOT polypeptide can catalyze production of cannabigerolic acid from GPP and olivetolic acid in an amount at least ten times higher than a polypeptide comprising an amino acid sequence set forth in SEQ ID NO:82. In some embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:100 or SEQ ID NO:110. In certain such embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:110. In some embodiments, the TKS polypeptide comprises an amino acid sequence having at least 50% sequence identity to SEQ ID NO:11 or SEQ ID NO:76; the OAC polypeptide comprises an amino acid sequence having at least 50% sequence identity to SEQ ID NO:10 or SEQ ID NO:78; and the THCA synthase polypeptide comprises an amino acid sequence having at least 50% sequence identity to SEQ ID NO:14, SEQ ID NO:86, SEQ ID NO:104, SEQ ID NO:153, or SEQ ID NO:155.

The present disclosure provides a genetically modified host cell for producing a cannabinoid or a cannabinoid derivative, wherein the genetically modified host cell is genetically modified with: a) one or more heterologous nucleic acids that encode a GOT polypeptide, b) one or more heterologous nucleic acids that encode a TKS polypeptide and one or more heterologous nucleic acids that encode an OAC polypeptide, and c) one or more heterologous nucleic acids that encode a CBDA synthase polypeptide. In certain such embodiments, the GOT polypeptide can catalyze production of cannabigerolic acid from GPP and olivetolic acid in an amount at least ten times higher than a polypeptide comprising an amino acid sequence set forth in SEQ ID NO:82. In some embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:100 or SEQ ID NO:110. In certain such embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:110. In some embodiments, the TKS polypeptide comprises an amino acid sequence having at least 50% sequence identity to SEQ ID NO:11 or SEQ ID NO:76; the OAC polypeptide comprises an amino acid sequence having at least 50% sequence identity to SEQ ID NO:10 or SEQ ID NO:78; and the CBDA synthase polypeptide comprises an amino acid sequence having at least 50% sequence identity to SEQ ID NO:88 or SEQ ID NO:151.

The present disclosure provides a genetically modified host cell for producing a cannabinoid or a cannabinoid derivative, wherein the genetically modified host cell is genetically modified with: a) one or more heterologous nucleic acids that encode a GOT polypeptide and b) one or more heterologous nucleic acids that encode a polypeptide that generates GPP. In certain such embodiments, the GOT polypeptide can catalyze production of cannabigerolic acid from GPP and olivetolic acid in an amount at least ten times higher than a polypeptide comprising an amino acid sequence set forth in SEQ ID NO:82. In some embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:100 or SEQ ID NO:110. In certain such embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:110. In some embodiments, the polypeptide that generates GPP is a GPPS polypeptide and comprises an amino acid sequence having at least 50% sequence identity to SEQ ID NO:7, SEQ ID NO:8, or SEQ ID NO:60.

The present disclosure provides a genetically modified host cell for producing a cannabinoid or a cannabinoid derivative, wherein the genetically modified host cell is genetically modified with: a) one or more heterologous nucleic acids that encode a GOT polypeptide, b) one or more heterologous nucleic acids that encode a polypeptide that generates GPP, and c) one or more heterologous nucleic acids that encode a THCA synthase polypeptide. In certain such embodiments, the GOT polypeptide can catalyze production of cannabigerolic acid from GPP and olivetolic acid in an amount at least ten times higher than a polypeptide comprising an amino acid sequence set forth in SEQ ID NO:82. In some embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:100 or SEQ ID NO:110. In certain such embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:110. In some embodiments, the polypeptide that generates GPP is a GPPS polypeptide and comprises an amino acid sequence having at least 50% sequence identity to SEQ ID NO:7, SEQ ID NO:8, or SEQ ID NO:60; and the THCA synthase polypeptide comprises an amino acid sequence having at least 50% sequence identity to SEQ ID NO:14, SEQ ID NO:86, SEQ ID NO:104, SEQ ID NO:153, or SEQ ID NO:155.

The present disclosure provides a genetically modified host cell for producing a cannabinoid or a cannabinoid derivative, wherein the genetically modified host cell is genetically modified with: a) one or more heterologous nucleic acids that encode a GOT polypeptide, b) one or more heterologous nucleic acids that encode a polypeptide that generates GPP, and c) one or more heterologous nucleic acids that encode a CBDA synthase polypeptide. In certain such embodiments, the GOT polypeptide can catalyze production of cannabigerolic acid from GPP and olivetolic acid in an amount at least ten times higher than a polypeptide comprising an amino acid sequence set forth in SEQ ID NO:82. In some embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:100 or SEQ ID NO:110. In certain such embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:110. In some embodiments, the polypeptide that generates GPP is a GPPS polypeptide and comprises an amino acid sequence having at least 50% sequence identity to SEQ ID NO:7, SEQ ID NO:8, or SEQ ID NO:60; and the CBDA synthase polypeptide comprises an amino acid sequence having at least 50% sequence identity to SEQ ID NO:88 or SEQ ID NO:151.

The present disclosure provides a genetically modified host cell for producing a cannabinoid or a cannabinoid derivative, wherein the genetically modified host cell is genetically modified with: a) one or more heterologous nucleic acids that encode a GOT polypeptide; b) one or more heterologous nucleic acids that encode a polypeptide that generates an acyl-CoA compound or an acyl-CoA compound derivative; and c) one or more heterologous nucleic acids that encode a TKS polypeptide and one or more heterologous nucleic acids that encode an OAC polypeptide. In certain such embodiments, the GOT polypeptide can catalyze production of cannabigerolic acid from GPP and olivetolic acid in an amount at least ten times higher than a polypeptide comprising an amino acid sequence set forth in SEQ ID NO:82. In some embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:100 or SEQ ID NO:110. In certain such embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:110. In some embodiments, the polypeptide that generates an acyl-CoA compound or an acyl-CoA compound derivative comprises an amino acid sequence having at least 50% sequence identity to SEQ ID NO:90, SEQ ID NO:92, SEQ ID NO:145, SEQ ID NO:147, SEQ ID NO:149, SEQ ID NO:169, SEQ ID NO:192, SEQ ID NO:194, SEQ ID NO:196, SEQ ID NO:198, or SEQ ID NO:200; the TKS polypeptide comprises an amino acid sequence having at least 50% sequence identity to SEQ ID NO:11 or SEQ ID NO:76; and the OAC polypeptide comprises an amino acid sequence having at least 50% sequence identity to SEQ ID NO:10 or SEQ ID NO:78.

The present disclosure provides a genetically modified host cell for producing a cannabinoid or a cannabinoid derivative, wherein the genetically modified host cell is genetically modified with: a) one or more heterologous nucleic acids that encode a GOT polypeptide; b) one or more heterologous nucleic acids that encode a polypeptide that generates an acyl-CoA compound or an acyl-CoA compound derivative; c) one or more heterologous nucleic acids that encode a TKS polypeptide and one or more heterologous nucleic acids that encode an OAC polypeptide; and d) one or more heterologous nucleic acids that encode a THCA synthase polypeptide. In certain such embodiments, the GOT polypeptide can catalyze production of cannabigerolic acid from GPP and olivetolic acid in an amount at least ten times higher than a polypeptide comprising an amino acid sequence set forth in SEQ ID NO:82. In some embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:100 or SEQ ID NO:110. In certain such embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:110. In some embodiments, the polypeptide that generates an acyl-CoA compound or an acyl-CoA compound derivative comprises an amino acid sequence having at least 50% sequence identity to SEQ ID NO:90, SEQ ID NO:92, SEQ ID NO:145, SEQ ID NO:147, SEQ ID NO:149, SEQ ID NO:169, SEQ ID NO:192, SEQ ID NO:194, SEQ ID NO:196, SEQ ID NO:198, or SEQ ID NO:200; the TKS polypeptide comprises an amino acid sequence having at least 50% sequence identity to SEQ ID NO:11 or SEQ ID NO:76; the OAC polypeptide comprises an amino acid sequence having at least 50% sequence identity to SEQ ID NO:10 or SEQ ID NO:78; and the THCA synthase polypeptide comprises an amino acid sequence having at least 50% sequence identity to SEQ ID NO:14, SEQ ID NO:86, SEQ ID NO:104, SEQ ID NO:153, or SEQ ID NO:155.

The present disclosure provides a genetically modified host cell for producing a cannabinoid or a cannabinoid derivative, wherein the genetically modified host cell is genetically modified with: a) one or more heterologous nucleic acids that encode a GOT polypeptide; b) one or more heterologous nucleic acids that encode a polypeptide that generates an acyl-CoA compound or an acyl-CoA compound derivative; c) one or more heterologous nucleic acids that encode a TKS polypeptide and one or more heterologous nucleic acids that encode an OAC polypeptide; and d) one or more heterologous nucleic acids that encode a CBDA synthase polypeptide. In certain such embodiments, the GOT polypeptide can catalyze production of cannabigerolic acid from GPP and olivetolic acid in an amount at least ten times higher than a polypeptide comprising an amino acid sequence set forth in SEQ ID NO:82. In some embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:100 or SEQ ID NO:110. In certain such embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:110. In some embodiments, the polypeptide that generates an acyl-CoA compound or an acyl-CoA compound derivative comprises an amino acid sequence having at least 50% sequence identity to SEQ ID NO:90, SEQ ID NO:92, SEQ ID NO:145, SEQ ID NO:147, SEQ ID NO:149, SEQ ID NO:169, SEQ ID NO:192, SEQ ID NO:194, SEQ ID NO:196, SEQ ID NO:198, or SEQ ID NO:200; the TKS polypeptide comprises an amino acid sequence having at least 50% sequence identity to SEQ ID NO:11 or SEQ ID NO:76; the OAC polypeptide comprises an amino acid sequence having at least 50% sequence identity to SEQ ID NO:10 or SEQ ID NO:78; and the CBDA synthase polypeptide comprises an amino acid sequence having at least 50% sequence identity to SEQ ID NO:88 or SEQ ID NO:151.

The present disclosure provides a genetically modified host cell for producing a cannabinoid or a cannabinoid derivative, wherein the genetically modified host cell is genetically modified with: a) one or more heterologous nucleic acids that encode a GOT polypeptide; b) one or more heterologous nucleic acids that encode a polypeptide that generates an acyl-CoA compound or an acyl-CoA compound derivative; c) one or more heterologous nucleic acids that encode a TKS polypeptide and one or more heterologous nucleic acids that encode an OAC polypeptide; and d) one or more heterologous nucleic acids that encode a polypeptide that generates malonyl-CoA. In certain such embodiments, the GOT polypeptide can catalyze production of cannabigerolic acid from GPP and olivetolic acid in an amount at least ten times higher than a polypeptide comprising an amino acid sequence set forth in SEQ ID NO:82. In some embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:100 or SEQ ID NO:110. In certain such embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:110. In some embodiments, the polypeptide that generates an acyl-CoA compound or an acyl-CoA compound derivative comprises an amino acid sequence having at least 50% sequence identity to SEQ ID NO:90, SEQ ID NO:92, SEQ ID NO:145, SEQ ID NO:147, SEQ ID NO:149, SEQ ID NO:169, SEQ ID NO:192, SEQ ID NO:194, SEQ ID NO:196, SEQ ID NO:198, or SEQ ID NO:200; the TKS polypeptide comprises an amino acid sequence having at least 50% sequence identity to SEQ ID NO:11 or SEQ ID NO:76; the OAC polypeptide comprises an amino acid sequence having at least 50% sequence identity to SEQ ID NO:10 or SEQ ID NO:78; and the polypeptide that generates malonyl-CoA is an ACC polypeptide and comprises an amino acid sequence having at least 50% sequence identity to SEQ ID NO:9, SEQ ID NO:97, or SEQ ID NO:207.

The present disclosure provides a genetically modified host cell for producing a cannabinoid or a cannabinoid derivative, wherein the genetically modified host cell is genetically modified with: a) one or more heterologous nucleic acids that encode a GOT polypeptide; b) one or more heterologous nucleic acids that encode a polypeptide that generates an acyl-CoA compound or an acyl-CoA compound derivative; c) one or more heterologous nucleic acids that encode a TKS polypeptide and one or more heterologous nucleic acids that encode an OAC polypeptide; d) one or more heterologous nucleic acids that encode a polypeptide that generates malonyl-CoA; and e) one or more heterologous nucleic acids that encode a THCA synthase polypeptide. In certain such embodiments, the GOT polypeptide can catalyze production of cannabigerolic acid from GPP and olivetolic acid in an amount at least ten times higher than a polypeptide comprising an amino acid sequence set forth in SEQ ID NO:82. In some embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:100 or SEQ ID NO:110. In certain such embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:110. In some embodiments, the polypeptide that generates an acyl-CoA compound or an acyl-CoA compound derivative comprises an amino acid sequence having at least 50% sequence identity to SEQ ID NO:90, SEQ ID NO:92, SEQ ID NO:145, SEQ ID NO:147, SEQ ID NO:149, SEQ ID NO:169, SEQ ID NO:192, SEQ ID NO:194, SEQ ID NO:196, SEQ ID NO:198, or SEQ ID NO:200; the TKS polypeptide comprises an amino acid sequence having at least 50% sequence identity to SEQ ID NO:11 or SEQ ID NO:76; the OAC polypeptide comprises an amino acid sequence having at least 50% sequence identity to SEQ ID NO:10 or SEQ ID NO:78; the polypeptide that generates malonyl-CoA is an ACC polypeptide and comprises an amino acid sequence having at least 50% sequence identity to SEQ ID NO:9, SEQ ID NO:97, or SEQ ID NO:207; and the THCA synthase polypeptide comprises an amino acid sequence having at least 50% sequence identity to SEQ ID NO:14, SEQ ID NO:86, SEQ ID NO:104, SEQ ID NO:153, or SEQ ID NO:155.

The present disclosure provides a genetically modified host cell for producing a cannabinoid or a cannabinoid derivative, wherein the genetically modified host cell is genetically modified with: a) one or more heterologous nucleic acids that encode a GOT polypeptide; b) one or more heterologous nucleic acids that encode a polypeptide that generates an acyl-CoA compound or an acyl-CoA compound derivative; c) one or more heterologous nucleic acids that encode a TKS polypeptide and one or more heterologous nucleic acids that encode an OAC polypeptide; d) one or more heterologous nucleic acids that encode a polypeptide that generates malonyl-CoA; and e) one or more heterologous nucleic acids that encode a CBDA synthase polypeptide. In certain such embodiments, the GOT polypeptide can catalyze production of cannabigerolic acid from GPP and olivetolic acid in an amount at least ten times higher than a polypeptide comprising an amino acid sequence set forth in SEQ ID NO:82. In some embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:100 or SEQ ID NO:110. In certain such embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:110. In some embodiments, the polypeptide that generates an acyl-CoA compound or an acyl-CoA compound derivative comprises an amino acid sequence having at least 50% sequence identity to SEQ ID NO:90, SEQ ID NO:92, SEQ ID NO:145, SEQ ID NO:147, SEQ ID NO:149, SEQ ID NO:169, SEQ ID NO:192, SEQ ID NO:194, SEQ ID NO:196, SEQ ID NO:198, or SEQ ID NO:200; the TKS polypeptide comprises an amino acid sequence having at least 50% sequence identity to SEQ ID NO:11 or SEQ ID NO:76; the OAC polypeptide comprises an amino acid sequence having at least 50% sequence identity to SEQ ID NO:10 or SEQ ID NO:78; the polypeptide that generates malonyl-CoA is an ACC polypeptide and comprises an amino acid sequence having at least 50% sequence identity to SEQ ID NO:9, SEQ ID NO:97, or SEQ ID NO:207; and the CBDA synthase polypeptide comprises an amino acid sequence having at least 50% sequence identity to SEQ ID NO:88 or SEQ ID NO:151.

The present disclosure provides a genetically modified host cell for producing a cannabinoid or a cannabinoid derivative, wherein the genetically modified host cell is genetically modified with: a) one or more heterologous nucleic acids that encode a GOT polypeptide; b) one or more heterologous nucleic acids that encode a polypeptide that generates an acyl-CoA compound or an acyl-CoA compound derivative; c) one or more heterologous nucleic acids that encode a polypeptide that generates GPP; and d) one or more heterologous nucleic acids that encode a TKS polypeptide and one or more heterologous nucleic acids that encode an OAC polypeptide. In certain such embodiments, the GOT polypeptide can catalyze production of cannabigerolic acid from GPP and olivetolic acid in an amount at least ten times higher than a polypeptide comprising an amino acid sequence set forth in SEQ ID NO:82. In some embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:100 or SEQ ID NO:110. In certain such embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:110. In some embodiments, the polypeptide that generates an acyl-CoA compound or an acyl-CoA compound derivative comprises an amino acid sequence having at least 50% sequence identity to SEQ ID NO:90, SEQ ID NO:92, SEQ ID NO:145, SEQ ID NO:147, SEQ ID NO:149, SEQ ID NO:169, SEQ ID NO:192, SEQ ID NO:194, SEQ ID NO:196, SEQ ID NO:198, or SEQ ID NO:200; the polypeptide that generates GPP is a GPPS polypeptide and comprises an amino acid sequence having at least 50% sequence identity to SEQ ID NO:7, SEQ ID NO:8, or SEQ ID NO:60; the TKS polypeptide comprises an amino acid sequence having at least 50% sequence identity to SEQ ID NO:11 or SEQ ID NO:76; and the OAC polypeptide comprises an amino acid sequence having at least 50% sequence identity to SEQ ID NO:10 or SEQ ID NO:78.

The present disclosure provides a genetically modified host cell for producing a cannabinoid or a cannabinoid derivative, wherein the genetically modified host cell is genetically modified with: a) one or more heterologous nucleic acids that encode a GOT polypeptide; b) one or more heterologous nucleic acids that encode a polypeptide that generates an acyl-CoA compound or an acyl-CoA compound derivative; c) one or more heterologous nucleic acids that encode a TKS polypeptide and one or more heterologous nucleic acids that encode an OAC polypeptide; d) one or more heterologous nucleic acids that encode a polypeptide that generates GPP; and e) one or more heterologous nucleic acids that encode a THCA synthase polypeptide. In certain such embodiments, the GOT polypeptide can catalyze production of cannabigerolic acid from GPP and olivetolic acid in an amount at least ten times higher than a polypeptide comprising an amino acid sequence set forth in SEQ ID NO:82. In some embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:100 or SEQ ID NO:110. In certain such embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:110. In some embodiments, the polypeptide that generates an acyl-CoA compound or an acyl-CoA compound derivative comprises an amino acid sequence having at least 50% sequence identity to SEQ ID NO:90, SEQ ID NO:92, SEQ ID NO:145, SEQ ID NO:147, SEQ ID NO:149, SEQ ID NO:169, SEQ ID NO:192, SEQ ID NO:194, SEQ ID NO:196, SEQ ID NO:198, or SEQ ID NO:200; the TKS polypeptide comprises an amino acid sequence having at least 50% sequence identity to SEQ ID NO:11 or SEQ ID NO:76; the OAC polypeptide comprises an amino acid sequence having at least 50% sequence identity to SEQ ID NO:10 or SEQ ID NO:78; the polypeptide that generates GPP is a GPPS polypeptide and comprises an amino acid sequence having at least 50% sequence identity to SEQ ID NO:7, SEQ ID NO:8, or SEQ ID NO:60; and the THCA synthase polypeptide comprises an amino acid sequence having at least 50% sequence identity to SEQ ID NO:14, SEQ ID NO:86, SEQ ID NO:104, SEQ ID NO:153, or SEQ ID NO:155.

The present disclosure provides a genetically modified host cell for producing a cannabinoid or a cannabinoid derivative, wherein the genetically modified host cell is genetically modified with: a) one or more heterologous nucleic acids that encode a GOT polypeptide; b) one or more heterologous nucleic acids that encode a polypeptide that generates an acyl-CoA compound or an acyl-CoA compound derivative; c) one or more heterologous nucleic acids that encode a TKS polypeptide and one or more heterologous nucleic acids that encode an OAC polypeptide; d) one or more heterologous nucleic acids that encode a polypeptide that generates GPP; and e) one or more heterologous nucleic acids that encode a CBDA synthase polypeptide. In certain such embodiments, the GOT polypeptide can catalyze production of cannabigerolic acid from GPP and olivetolic acid in an amount at least ten times higher than a polypeptide comprising an amino acid sequence set forth in SEQ ID NO:82. In some embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:100 or SEQ ID NO:110. In certain such embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:110. In some embodiments, the polypeptide that generates an acyl-CoA compound or an acyl-CoA compound derivative comprises an amino acid sequence having at least 50% sequence identity to SEQ ID NO:90, SEQ ID NO:92, SEQ ID NO:145, SEQ ID NO:147, SEQ ID NO:149, SEQ ID NO:169, SEQ ID NO:192, SEQ ID NO:194, SEQ ID NO:196, SEQ ID NO:198, or SEQ ID NO:200; the TKS polypeptide comprises an amino acid sequence having at least 50% sequence identity to SEQ ID NO:11 or SEQ ID NO:76; the OAC polypeptide comprises an amino acid sequence having at least 50% sequence identity to SEQ ID NO:10 or SEQ ID NO:78; the polypeptide that generates GPP is a GPPS polypeptide and comprises an amino acid sequence having at least 50% sequence identity to SEQ ID NO:7, SEQ ID NO:8, or SEQ ID NO:60; and the CBDA synthase polypeptide comprises an amino acid sequence having at least 50% sequence identity to SEQ ID NO:88 or SEQ ID NO:151.

The present disclosure provides a genetically modified host cell for producing a cannabinoid or a cannabinoid derivative, wherein the genetically modified host cell is genetically modified with: a) one or more heterologous nucleic acids that encode a GOT polypeptide; b) one or more heterologous nucleic acids that encode a polypeptide that generates an acyl-CoA compound or an acyl-CoA compound derivative; c) one or more heterologous nucleic acids that encode a TKS polypeptide and one or more heterologous nucleic acids that encode an OAC polypeptide; d) one or more heterologous nucleic acids that encode a polypeptide that generates GPP; and e) one or more heterologous nucleic acids that encode a polypeptide that generates malonyl-CoA. In certain such embodiments, the GOT polypeptide can catalyze production of cannabigerolic acid from GPP and olivetolic acid in an amount at least ten times higher than a polypeptide comprising an amino acid sequence set forth in SEQ ID NO:82. In some embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:100 or SEQ ID NO:110. In certain such embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:110. In some embodiments, the polypeptide that generates an acyl-CoA compound or an acyl-CoA compound derivative comprises an amino acid sequence having at least 50% sequence identity to SEQ ID NO:90, SEQ ID NO:92, SEQ ID NO:145, SEQ ID NO:147, SEQ ID NO:149, SEQ ID NO:169, SEQ ID NO:192, SEQ ID NO:194, SEQ ID NO:196, SEQ ID NO:198, or SEQ ID NO:200; the TKS polypeptide comprises an amino acid sequence having at least 50% sequence identity to SEQ ID NO:11 or SEQ ID NO:76; the OAC polypeptide comprises an amino acid sequence having at least 50% sequence identity to SEQ ID NO:10 or SEQ ID NO:78; the polypeptide that generates GPP is a GPPS polypeptide and comprises an amino acid sequence having at least 50% sequence identity to SEQ ID NO:7, SEQ ID NO:8, or SEQ ID NO:60; and the polypeptide that generates malonyl-CoA is an ACC polypeptide and comprises an amino acid sequence having at least 50% sequence identity to SEQ ID NO:9, SEQ ID NO:97, or SEQ ID NO:207.

The present disclosure provides a genetically modified host cell for producing a cannabinoid or a cannabinoid derivative, wherein the genetically modified host cell is genetically modified with: a) one or more heterologous nucleic acids that encode a GOT polypeptide; b) one or more heterologous nucleic acids that encode a polypeptide that generates an acyl-CoA compound or an acyl-CoA compound derivative; c) one or more heterologous nucleic acids that encode a TKS polypeptide and one or more heterologous nucleic acids that encode an OAC polypeptide; d) one or more heterologous nucleic acids that encode a polypeptide that generates malonyl-CoA; e) one or more heterologous nucleic acids that encode a polypeptide that generates GPP; and f) one or more heterologous nucleic acids that encode a THCA synthase polypeptide. In certain such embodiments, the GOT polypeptide can catalyze production of cannabigerolic acid from GPP and olivetolic acid in an amount at least ten times higher than a polypeptide comprising an amino acid sequence set forth in SEQ ID NO:82. In some embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:100 or SEQ ID NO:110. In certain such embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:110. In some embodiments, the polypeptide that generates an acyl-CoA compound or an acyl-CoA compound derivative comprises an amino acid sequence having at least 50% sequence identity to SEQ ID NO:90, SEQ ID NO:92, SEQ ID NO:145, SEQ ID NO:147, SEQ ID NO:149, SEQ ID NO:169, SEQ ID NO:192, SEQ ID NO:194, SEQ ID NO:196, SEQ ID NO:198, or SEQ ID NO:200; the TKS polypeptide comprises an amino acid sequence having at least 50% sequence identity to SEQ ID NO:11 or SEQ ID NO:76; the OAC polypeptide comprises an amino acid sequence having at least 50% sequence identity to SEQ ID NO:10 or SEQ ID NO:78; the polypeptide that generates malonyl-CoA is an ACC polypeptide and comprises an amino acid sequence having at least 50% sequence identity to SEQ ID NO:9, SEQ ID NO:97, or SEQ ID NO:207; the polypeptide that generates GPP is a GPPS polypeptide and comprises an amino acid sequence having at least 50% sequence identity to SEQ ID NO:7, SEQ ID NO:8, or SEQ ID NO:60; and the THCA synthase polypeptide comprises an amino acid sequence having at least 50% sequence identity to SEQ ID NO:14, SEQ ID NO:86, SEQ ID NO:104, SEQ ID NO:153, or SEQ ID NO:155.

The present disclosure provides a genetically modified host cell for producing a cannabinoid or a cannabinoid derivative, wherein the genetically modified host cell is genetically modified with: a) one or more heterologous nucleic acids that encode a GOT polypeptide; b) one or more heterologous nucleic acids that encode a polypeptide that generates an acyl-CoA compound or an acyl-CoA compound derivative; c) one or more heterologous nucleic acids that encode a TKS polypeptide and one or more heterologous nucleic acids that encode an OAC polypeptide; d) one or more heterologous nucleic acids that encode a polypeptide that generates malonyl-CoA; e) one or more heterologous nucleic acids that encode a polypeptide that generates GPP; and f) one or more heterologous nucleic acids that encode a CBDA synthase polypeptide. In certain such embodiments, the GOT polypeptide can catalyze production of cannabigerolic acid from GPP and olivetolic acid in an amount at least ten times higher than a polypeptide comprising an amino acid sequence set forth in SEQ ID NO:82. In some embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:100 or SEQ ID NO:110. In certain such embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:110. In some embodiments, the polypeptide that generates an acyl-CoA compound or an acyl-CoA compound derivative comprises an amino acid sequence having at least 50% sequence identity to SEQ ID NO:90, SEQ ID NO:92, SEQ ID NO:145, SEQ ID NO:147, SEQ ID NO:149, SEQ ID NO:169, SEQ ID NO:192, SEQ ID NO:194, SEQ ID NO:196, SEQ ID NO:198, or SEQ ID NO:200; the TKS polypeptide comprises an amino acid sequence having at least 50% sequence identity to SEQ ID NO:11 or SEQ ID NO:76; the OAC polypeptide comprises an amino acid sequence having at least 50% sequence identity to SEQ ID NO:10 or SEQ ID NO:78; the polypeptide that generates malonyl-CoA is an ACC polypeptide and comprises an amino acid sequence having at least 50% sequence identity to SEQ ID NO:9, SEQ ID NO:97, or SEQ ID NO:207; the polypeptide that generates GPP is a GPPS polypeptide and comprises an amino acid sequence having at least 50% sequence identity to SEQ ID NO:7, SEQ ID NO:8, or SEQ ID NO:60; and the CBDA synthase polypeptide comprises an amino acid sequence having at least 50% sequence identity to SEQ ID NO:88 or SEQ ID NO:151.

The present disclosure provides a genetically modified host cell for producing a cannabinoid or a cannabinoid derivative, wherein the genetically modified host cell is genetically modified with: a) one or more heterologous nucleic acids that encode a GOT polypeptide; b) one or more heterologous nucleic acids that encode a polypeptide that generates GPP; c) one or more heterologous nucleic acids that encode one or more of the following polypeptides: a HMGS polypeptide, a tHMGR polypeptide, a MK polypeptide, a PMK polypeptide, a MVD polypeptide, or an IDI polypeptide; d) one or more heterologous nucleic acids that encode a polypeptide that condenses two molecules of acetyl-CoA to generate acetoacetyl-CoA; and e) one or more heterologous nucleic acids that encode a PDC polypeptide. In certain such embodiments, the GOT polypeptide can catalyze production of cannabigerolic acid from GPP and olivetolic acid in an amount at least ten times higher than a polypeptide comprising an amino acid sequence set forth in SEQ ID NO:82. In some embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:100 or SEQ ID NO:110. In certain such embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:110. In some embodiments, the polypeptide that generates GPP is a GPPS polypeptide and comprises an amino acid sequence having at least 50% sequence identity to SEQ ID NO:7, SEQ ID NO:8, or SEQ ID NO:60; the IDI polypeptide comprises an amino acid sequence having at least 50% sequence identity to SEQ ID NO:58; the tHMGR polypeptide comprises an amino acid sequence having at least 50% sequence identity to SEQ ID NO:17, SEQ ID NO:52, SEQ ID NO:113, or SEQ ID NO:208; the HMGS polypeptide comprises an amino acid sequence having at least 50% sequence identity to SEQ ID NO:23, SEQ ID NO:24, or SEQ ID NO:115; the MK polypeptide comprises an amino acid sequence having at least 50% sequence identity to SEQ ID NO:64; the PMK polypeptide comprises an amino acid sequence having at least 50% sequence identity to SEQ ID NO:62 or SEQ ID NO:205; the MVD polypeptide comprises an amino acid sequence having at least 50% sequence identity to SEQ ID NO:66; the polypeptide that condenses two molecules of acetyl-CoA to generate acetoacetyl-CoA is an acetoacetyl-CoA thiolase polypeptide and comprises an amino acid sequence having at least 50% sequence identity to SEQ ID NO:25; and the PDC polypeptide comprises an amino acid sequence having at least 50% sequence identity to SEQ ID NO:117.

The present disclosure provides a genetically modified host cell for producing a cannabinoid or a cannabinoid derivative, wherein the genetically modified host cell is genetically modified with: a) one or more heterologous nucleic acids that encode a GOT polypeptide; b) one or more heterologous nucleic acids that encode a polypeptide that generates GPP; c) one or more heterologous nucleic acids that encode a THCA synthase polypeptide; d) one or more heterologous nucleic acids that encode one or more of the following polypeptides: a HMGS polypeptide, a tHMGR polypeptide, a MK polypeptide, a PMK polypeptide, a MVD polypeptide, or an IDI polypeptide; e) one or more heterologous nucleic acids that encode a polypeptide that condenses two molecules of acetyl-CoA to generate acetoacetyl-CoA; and f) one or more heterologous nucleic acids that encode a PDC polypeptide. In certain such embodiments, the GOT polypeptide can catalyze production of cannabigerolic acid from GPP and olivetolic acid in an amount at least ten times higher than a polypeptide comprising an amino acid sequence set forth in SEQ ID NO:82. In some embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:100 or SEQ ID NO:110. In certain such embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:110. In some embodiments, the polypeptide that generates GPP is a GPPS polypeptide and comprises an amino acid sequence having at least 50% sequence identity to SEQ ID NO:7, SEQ ID NO:8, or SEQ ID NO:60; the IDI polypeptide comprises an amino acid sequence having at least 50% sequence identity to SEQ ID NO:58; the tHMGR polypeptide comprises an amino acid sequence having at least 50% sequence identity to SEQ ID NO:17, SEQ ID NO:52, SEQ ID NO:113, or SEQ ID NO:208; the HMGS polypeptide comprises an amino acid sequence having at least 50% sequence identity to SEQ ID NO:23, SEQ ID NO:24, or SEQ ID NO:115; the MK polypeptide comprises an amino acid sequence having at least 50% sequence identity to SEQ ID NO:64; the PMK polypeptide comprises an amino acid sequence having at least 50% sequence identity to SEQ ID NO:62 or SEQ ID NO:205; the MVD polypeptide comprises an amino acid sequence having at least 50% sequence identity to SEQ ID NO:66; the polypeptide that condenses two molecules of acetyl-CoA to generate acetoacetyl-CoA is an acetoacetyl-CoA thiolase polypeptide and comprises an amino acid sequence having at least 50% sequence identity to SEQ ID NO:25; the PDC polypeptide comprises an amino acid sequence having at least 50% sequence identity to SEQ ID NO:117; and the THCA synthase polypeptide comprises an amino acid sequence having at least 50% sequence identity to SEQ ID NO:14, SEQ ID NO:86, SEQ ID NO:104, SEQ ID NO:153, or SEQ ID NO:155.

The present disclosure provides a genetically modified host cell for producing a cannabinoid or a cannabinoid derivative, wherein the genetically modified host cell is genetically modified with: a) one or more heterologous nucleic acids that encode a GOT polypeptide; b) one or more heterologous nucleic acids that encode a polypeptide that generates GPP; c) one or more heterologous nucleic acids that encode a CBDA synthase polypeptide; d) one or more heterologous nucleic acids that encode one or more of the following polypeptides: a HMGS polypeptide, a tHMGR polypeptide, a MK polypeptide, a PMK polypeptide, a MVD polypeptide, or an polypeptide; e) one or more heterologous nucleic acids that encode a polypeptide that condenses two molecules of acetyl-CoA to generate acetoacetyl-CoA; and f) one or more heterologous nucleic acids that encode a PDC polypeptide. In certain such embodiments, the GOT polypeptide can catalyze production of cannabigerolic acid from GPP and olivetolic acid in an amount at least ten times higher than a polypeptide comprising an amino acid sequence set forth in SEQ ID NO:82. In some embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:100 or SEQ ID NO:110. In certain such embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:110. In some embodiments, the polypeptide that generates GPP is a GPPS polypeptide and comprises an amino acid sequence having at least 50% sequence identity to SEQ ID NO:7, SEQ ID NO:8, or SEQ ID NO:60; the IDI polypeptide comprises an amino acid sequence having at least 50% sequence identity to SEQ ID NO:58; the tHMGR polypeptide comprises an amino acid sequence having at least 50% sequence identity to SEQ ID NO:17, SEQ ID NO:52, SEQ ID NO:113, or SEQ ID NO:208; the HMGS polypeptide comprises an amino acid sequence having at least 50% sequence identity to SEQ ID NO:23, SEQ ID NO:24, or SEQ ID NO:115; the MK polypeptide comprises an amino acid sequence having at least 50% sequence identity to SEQ ID NO:64; the PMK polypeptide comprises an amino acid sequence having at least 50% sequence identity to SEQ ID NO:62 or SEQ ID NO:205; the MVD polypeptide comprises an amino acid sequence having at least 50% sequence identity to SEQ ID NO:66; the polypeptide that condenses two molecules of acetyl-CoA to generate acetoacetyl-CoA is an acetoacetyl-CoA thiolase polypeptide and comprises an amino acid sequence having at least 50% sequence identity to SEQ ID NO:25; the PDC polypeptide comprises an amino acid sequence having at least 50% sequence identity to SEQ ID NO:117; and the CBDA synthase polypeptide comprises an amino acid sequence having at least 50% sequence identity to SEQ ID NO:88 or SEQ ID NO:151.

The present disclosure provides a genetically modified host cell for producing a cannabinoid or a cannabinoid derivative, wherein the genetically modified host cell is genetically modified with: a) one or more heterologous nucleic acids that encode a GOT polypeptide; b) one or more heterologous nucleic acids that encode a polypeptide that generates GPP; c) one or more heterologous nucleic acids that encode one or more of the following polypeptides: a HMGS polypeptide, a tHMGR polypeptide, a MK polypeptide, a PMK polypeptide, a MVD polypeptide, or an IDI polypeptide; d) one or more heterologous nucleic acids that encode a polypeptide that condenses two molecules of acetyl-CoA to generate acetoacetyl-CoA; e) one or more heterologous nucleic acids that encode a PDC polypeptide; and f) one or more heterologous nucleic acids that encode a polypeptide that generates an acyl-CoA compound or an acyl-CoA compound derivative. In certain such embodiments, the GOT polypeptide can catalyze production of cannabigerolic acid from GPP and olivetolic acid in an amount at least ten times higher than a polypeptide comprising an amino acid sequence set forth in SEQ ID NO:82. In some embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:100 or SEQ ID NO:110. In certain such embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:110. In some embodiments, the polypeptide that generates GPP is a GPPS polypeptide and comprises an amino acid sequence having at least 50% sequence identity to SEQ ID NO:7, SEQ ID NO:8, or SEQ ID NO:60; the IDI polypeptide comprises an amino acid sequence having at least 50% sequence identity to SEQ ID NO:58; the tHMGR polypeptide comprises an amino acid sequence having at least 50% sequence identity to SEQ ID NO:17, SEQ ID NO:52, SEQ ID NO:113, or SEQ ID NO:208; the HMGS polypeptide comprises an amino acid sequence having at least 50% sequence identity to SEQ ID NO:23, SEQ ID NO:24, or SEQ ID NO:115; the MK polypeptide comprises an amino acid sequence having at least 50% sequence identity to SEQ ID NO:64; the PMK polypeptide comprises an amino acid sequence having at least 50% sequence identity to SEQ ID NO:62 or SEQ ID NO:205; the MVD polypeptide comprises an amino acid sequence having at least 50% sequence identity to SEQ ID NO:66; the polypeptide that condenses two molecules of acetyl-CoA to generate acetoacetyl-CoA is an acetoacetyl-CoA thiolase polypeptide and comprises an amino acid sequence having at least 50% sequence identity to SEQ ID NO:25; the polypeptide that generates an acyl-CoA compound or an acyl-CoA compound derivative comprises an amino acid sequence having at least 50% sequence identity to SEQ ID NO:90, SEQ ID NO:92, SEQ ID NO:145, SEQ ID NO:147, SEQ ID NO:149, SEQ ID NO:169, SEQ ID NO:192, SEQ ID NO:194, SEQ ID NO:196, SEQ ID NO:198, or SEQ ID NO:200; and the PDC polypeptide comprises an amino acid sequence having at least 50% sequence identity to SEQ ID NO:117.

The present disclosure provides a genetically modified host cell for producing a cannabinoid or a cannabinoid derivative, wherein the genetically modified host cell is genetically modified with: a) one or more heterologous nucleic acids that encode a GOT polypeptide; b) one or more heterologous nucleic acids that encode a polypeptide that generates GPP; c) one or more heterologous nucleic acids that encode a THCA synthase polypeptide; d) one or more heterologous nucleic acids that encode one or more of the following polypeptides: a HMGS polypeptide, a tHMGR polypeptide, a MK polypeptide, a PMK polypeptide, a MVD polypeptide, or an IDI polypeptide; e) one or more heterologous nucleic acids that encode a polypeptide that condenses two molecules of acetyl-CoA to generate acetoacetyl-CoA; f) one or more heterologous nucleic acids that encode a PDC polypeptide; and g) one or more heterologous nucleic acids that encode a polypeptide that generates an acyl-CoA compound or an acyl-CoA compound derivative. In certain such embodiments, the GOT polypeptide can catalyze production of cannabigerolic acid from GPP and olivetolic acid in an amount at least ten times higher than a polypeptide comprising an amino acid sequence set forth in SEQ ID NO:82. In some embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:100 or SEQ ID NO:110. In certain such embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:110. In some embodiments, the polypeptide that generates GPP is a GPPS polypeptide and comprises an amino acid sequence having at least 50% sequence identity to SEQ ID NO:7, SEQ ID NO:8, or SEQ ID NO:60; the IDI polypeptide comprises an amino acid sequence having at least 50% sequence identity to SEQ ID NO:58; the tHMGR polypeptide comprises an amino acid sequence having at least 50% sequence identity to SEQ ID NO:17, SEQ ID NO:52, SEQ ID NO:113, or SEQ ID NO:208; the HMGS polypeptide comprises an amino acid sequence having at least 50% sequence identity to SEQ ID NO:23, SEQ ID NO:24, or SEQ ID NO:115; the MK polypeptide comprises an amino acid sequence having at least 50% sequence identity to SEQ ID NO:64; the PMK polypeptide comprises an amino acid sequence having at least 50% sequence identity to SEQ ID NO:62 or SEQ ID NO:205; the MVD polypeptide comprises an amino acid sequence having at least 50% sequence identity to SEQ ID NO:66; the polypeptide that condenses two molecules of acetyl-CoA to generate acetoacetyl-CoA is an acetoacetyl-CoA thiolase polypeptide and comprises an amino acid sequence having at least 50% sequence identity to SEQ ID NO:25; the PDC polypeptide comprises an amino acid sequence having at least 50% sequence identity to SEQ ID NO:117; the polypeptide that generates an acyl-CoA compound or an acyl-CoA compound derivative comprises an amino acid sequence having at least 50% sequence identity to SEQ ID NO:90, SEQ ID NO:92, SEQ ID NO:145, SEQ ID NO:147, SEQ ID NO:149, SEQ ID NO:169, SEQ ID NO:192, SEQ ID NO:194, SEQ ID NO:196, SEQ ID NO:198, or SEQ ID NO:200; and the THCA synthase polypeptide comprises an amino acid sequence having at least 50% sequence identity to SEQ ID NO:14, SEQ ID NO:86, SEQ ID NO:104, SEQ ID NO:153, or SEQ ID NO:155.

The present disclosure provides a genetically modified host cell for producing a cannabinoid or a cannabinoid derivative, wherein the genetically modified host cell is genetically modified with: a) one or more heterologous nucleic acids that encode a GOT polypeptide; b) one or more heterologous nucleic acids that encode a polypeptide that generates GPP; c) one or more heterologous nucleic acids that encode a CBDA synthase polypeptide; d) one or more heterologous nucleic acids that encode one or more of the following polypeptides: a HMGS polypeptide, a tHMGR polypeptide, a MK polypeptide, a PMK polypeptide, a MVD polypeptide, or an IDI polypeptide; e) one or more heterologous nucleic acids that encode a polypeptide that condenses two molecules of acetyl-CoA to generate acetoacetyl-CoA; f) one or more heterologous nucleic acids that encode a PDC polypeptide; and g) one or more heterologous nucleic acids that encode a polypeptide that generates an acyl-CoA compound or an acyl-CoA compound derivative. In certain such embodiments, the GOT polypeptide can catalyze production of cannabigerolic acid from GPP and olivetolic acid in an amount at least ten times higher than a polypeptide comprising an amino acid sequence set forth in SEQ ID NO:82. In some embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:100 or SEQ ID NO:110. In certain such embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:110. In some embodiments, the polypeptide that generates GPP is a GPPS polypeptide and comprises an amino acid sequence having at least 50% sequence identity to SEQ ID NO:7, SEQ ID NO:8, or SEQ ID NO:60; the IDI polypeptide comprises an amino acid sequence having at least 50% sequence identity to SEQ ID NO:58; the tHMGR polypeptide comprises an amino acid sequence having at least 50% sequence identity to SEQ ID NO:17, SEQ ID NO:52, SEQ ID NO:113, or SEQ ID NO:208; the HMGS polypeptide comprises an amino acid sequence having at least 50% sequence identity to SEQ ID NO:23, SEQ ID NO:24, or SEQ ID NO:115; the MK polypeptide comprises an amino acid sequence having at least 50% sequence identity to SEQ ID NO:64; the PMK polypeptide comprises an amino acid sequence having at least 50% sequence identity to SEQ ID NO:62 or SEQ ID NO:205; the MVD polypeptide comprises an amino acid sequence having at least 50% sequence identity to SEQ ID NO:66; the polypeptide that condenses two molecules of acetyl-CoA to generate acetoacetyl-CoA is an acetoacetyl-CoA thiolase polypeptide and comprises an amino acid sequence having at least 50% sequence identity to SEQ ID NO:25; the PDC polypeptide comprises an amino acid sequence having at least 50% sequence identity to SEQ ID NO:117; the polypeptide that generates an acyl-CoA compound or an acyl-CoA compound derivative comprises an amino acid sequence having at least 50% sequence identity to SEQ ID NO:90, SEQ ID NO:92, SEQ ID NO:145, SEQ ID NO:147, SEQ ID NO:149, SEQ ID NO:169, SEQ ID NO:192, SEQ ID NO:194, SEQ ID NO:196, SEQ ID NO:198, or SEQ ID NO:200; and the CBDA synthase polypeptide comprises an amino acid sequence having at least 50% sequence identity to SEQ ID NO:88 or SEQ ID NO:151.

The present disclosure provides a genetically modified host cell for producing a cannabinoid or a cannabinoid derivative, wherein the genetically modified host cell is genetically modified with: a) one or more heterologous nucleic acids that encode a GOT polypeptide; b) one or more heterologous nucleic acids that encode a polypeptide that generates GPP; c) one or more heterologous nucleic acids that encode one or more of the following polypeptides: a HMGS polypeptide, a tHMGR polypeptide, a MK polypeptide, a PMK polypeptide, a MVD polypeptide, or an IDI polypeptide; d) one or more heterologous nucleic acids that encode a polypeptide that condenses two molecules of acetyl-CoA to generate acetoacetyl-CoA; e) one or more heterologous nucleic acids that encode a PDC polypeptide; f) one or more heterologous nucleic acids that encode a TKS polypeptide and one or more heterologous nucleic acids that encode an OAC polypeptide; and g) one or more heterologous nucleic acids that encode a polypeptide that generates an acyl-CoA compound or an acyl-CoA compound derivative. In certain such embodiments, the GOT polypeptide can catalyze production of cannabigerolic acid from GPP and olivetolic acid in an amount at least ten times higher than a polypeptide comprising an amino acid sequence set forth in SEQ ID NO:82. In some embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:100 or SEQ ID NO:110. In certain such embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:110. In some embodiments, the polypeptide that generates GPP is a GPPS polypeptide and comprises an amino acid sequence having at least 50% sequence identity to SEQ ID NO:7, SEQ ID NO:8, or SEQ ID NO:60; the IDI polypeptide comprises an amino acid sequence having at least 50% sequence identity to SEQ ID NO:58; the tHMGR polypeptide comprises an amino acid sequence having at least 50% sequence identity to SEQ ID NO:17, SEQ ID NO:52, SEQ ID NO:113, or SEQ ID NO:208; the HMGS polypeptide comprises an amino acid sequence having at least 50% sequence identity to SEQ ID NO:23, SEQ ID NO:24, or SEQ ID NO:115; the MK polypeptide comprises an amino acid sequence having at least 50% sequence identity to SEQ ID NO:64; the PMK polypeptide comprises an amino acid sequence having at least 50% sequence identity to SEQ ID NO:62 or SEQ ID NO:205; the MVD polypeptide comprises an amino acid sequence having at least 50% sequence identity to SEQ ID NO:66; the polypeptide that condenses two molecules of acetyl-CoA to generate acetoacetyl-CoA is an acetoacetyl-CoA thiolase polypeptide and comprises an amino acid sequence having at least 50% sequence identity to SEQ ID NO:25; the polypeptide that generates an acyl-CoA compound or an acyl-CoA compound derivative comprises an amino acid sequence having at least 50% sequence identity to SEQ ID NO:90, SEQ ID NO:92, SEQ ID NO:145, SEQ ID NO:147, SEQ ID NO:149, SEQ ID NO:169, SEQ ID NO:192, SEQ ID NO:194, SEQ ID NO:196, SEQ ID NO:198, or SEQ ID NO:200; the PDC polypeptide comprises an amino acid sequence having at least 50% sequence identity to SEQ ID NO:117; the TKS polypeptide comprises an amino acid sequence having at least 50% sequence identity to SEQ ID NO:11 or SEQ ID NO:76; and the OAC polypeptide comprises an amino acid sequence having at least 50% sequence identity to SEQ ID NO:10 or SEQ ID NO:78.

The present disclosure provides a genetically modified host cell for producing a cannabinoid or a cannabinoid derivative, wherein the genetically modified host cell is genetically modified with: a) one or more heterologous nucleic acids that encode a GOT polypeptide; b) one or more heterologous nucleic acids that encode a polypeptide that generates GPP; c) one or more heterologous nucleic acids that encode a THCA synthase polypeptide; d) one or more heterologous nucleic acids that encode one or more of the following polypeptides: a HMGS polypeptide, a tHMGR polypeptide, a MK polypeptide, a PMK polypeptide, a MVD polypeptide, or an IDI polypeptide; e) one or more heterologous nucleic acids that encode a polypeptide that condenses two molecules of acetyl-CoA to generate acetoacetyl-CoA; f) one or more heterologous nucleic acids that encode a PDC polypeptide; g) one or more heterologous nucleic acids that encode a TKS polypeptide and one or more heterologous nucleic acids that encode an OAC polypeptide; and h) one or more heterologous nucleic acids that encode a polypeptide that generates an acyl-CoA compound or an acyl-CoA compound derivative. In certain such embodiments, the GOT polypeptide can catalyze production of cannabigerolic acid from GPP and olivetolic acid in an amount at least ten times higher than a polypeptide comprising an amino acid sequence set forth in SEQ ID NO:82. In some embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:100 or SEQ ID NO:110. In certain such embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:110. In some embodiments, the polypeptide that generates GPP is a GPPS polypeptide and comprises an amino acid sequence having at least 50% sequence identity to SEQ ID NO:7, SEQ ID NO:8, or SEQ ID NO:60; the IDI polypeptide comprises an amino acid sequence having at least 50% sequence identity to SEQ ID NO:58; the tHMGR polypeptide comprises an amino acid sequence having at least 50% sequence identity to SEQ ID NO:17, SEQ ID NO:52, SEQ ID NO:113, or SEQ ID NO:208; the HMGS polypeptide comprises an amino acid sequence having at least 50% sequence identity to SEQ ID NO:23, SEQ ID NO:24, or SEQ ID NO:115; the MK polypeptide comprises an amino acid sequence having at least 50% sequence identity to SEQ ID NO:64; the PMK polypeptide comprises an amino acid sequence having at least 50% sequence identity to SEQ ID NO:62 or SEQ ID NO:205; the MVD polypeptide comprises an amino acid sequence having at least 50% sequence identity to SEQ ID NO:66; the polypeptide that condenses two molecules of acetyl-CoA to generate acetoacetyl-CoA is an acetoacetyl-CoA thiolase polypeptide and comprises an amino acid sequence having at least 50% sequence identity to SEQ ID NO:25; the PDC polypeptide comprises an amino acid sequence having at least 50% sequence identity to SEQ ID NO:117; the polypeptide that generates an acyl-CoA compound or an acyl-CoA compound derivative comprises an amino acid sequence having at least 50% sequence identity to SEQ ID NO:90, SEQ ID NO:92, SEQ ID NO:145, SEQ ID NO:147, SEQ ID NO:149, SEQ ID NO:169, SEQ ID NO:192, SEQ ID NO:194, SEQ ID NO:196, SEQ ID NO:198, or SEQ ID NO:200; the THCA synthase polypeptide comprises an amino acid sequence having at least 50% sequence identity to SEQ ID NO:14, SEQ ID NO:86, SEQ ID NO:104, SEQ ID NO:153, or SEQ ID NO:155; the TKS polypeptide comprises an amino acid sequence having at least 50% sequence identity to SEQ ID NO:11 or SEQ ID NO:76; and the OAC polypeptide comprises an amino acid sequence having at least 50% sequence identity to SEQ ID NO:10 or SEQ ID NO:78.

The present disclosure provides a genetically modified host cell for producing a cannabinoid or a cannabinoid derivative, wherein the genetically modified host cell is genetically modified with: a) one or more heterologous nucleic acids that encode a GOT polypeptide; b) one or more heterologous nucleic acids that encode a polypeptide that generates GPP; c) one or more heterologous nucleic acids that encode a CBDA synthase polypeptide; d) one or more heterologous nucleic acids that encode one or more of the following polypeptides: a HMGS polypeptide, a tHMGR polypeptide, a MK polypeptide, a PMK polypeptide, a MVD polypeptide, or an IDI polypeptide; e) one or more heterologous nucleic acids that encode a polypeptide that condenses two molecules of acetyl-CoA to generate acetoacetyl-CoA; f) one or more heterologous nucleic acids that encode a PDC polypeptide; g) one or more heterologous nucleic acids that encode a TKS polypeptide and one or more heterologous nucleic acids that encode an OAC polypeptide; and h) one or more heterologous nucleic acids that encode a polypeptide that generates an acyl-CoA compound or an acyl-CoA compound derivative. In certain such embodiments, the GOT polypeptide can catalyze production of cannabigerolic acid from GPP and olivetolic acid in an amount at least ten times higher than a polypeptide comprising an amino acid sequence set forth in SEQ ID NO:82. In some embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%)

sequence identity to SEQ ID NO:100 or SEQ ID NO:110. In certain such embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:110. In some embodiments, the polypeptide that generates GPP is a GPPS polypeptide and comprises an amino acid sequence having at least 50% sequence identity to SEQ ID NO:7, SEQ ID NO:8, or SEQ ID NO:60; the IDI polypeptide comprises an amino acid sequence having at least 50% sequence identity to SEQ ID NO:58; the tHMGR polypeptide comprises an amino acid sequence having at least 50% sequence identity to SEQ ID NO:17, SEQ ID NO:52, SEQ ID NO:113, or SEQ ID NO:208; the HMGS polypeptide comprises an amino acid sequence having at least 50% sequence identity to SEQ ID NO:23, SEQ ID NO:24, or SEQ ID NO:115; the MK polypeptide comprises an amino acid sequence having at least 50% sequence identity to SEQ ID NO:64; the PMK polypeptide comprises an amino acid sequence having at least 50% sequence identity to SEQ ID NO:62 or SEQ ID NO:205; the MVD polypeptide comprises an amino acid sequence having at least 50% sequence identity to SEQ ID NO:66; the polypeptide that condenses two molecules of acetyl-CoA to generate acetoacetyl-CoA is an acetoacetyl-CoA thiolase polypeptide and comprises an amino acid sequence having at least 50% sequence identity to SEQ ID NO:25; the PDC polypeptide comprises an amino acid sequence having at least 50% sequence identity to SEQ ID NO:117; the polypeptide that generates an acyl-CoA compound or an acyl-CoA compound derivative comprises an amino acid sequence having at least 50% sequence identity to SEQ ID NO:90, SEQ ID NO:92, SEQ ID NO:145, SEQ ID NO:147, SEQ ID NO:149, SEQ ID NO:169, SEQ ID NO:192, SEQ ID NO:194, SEQ ID NO:196, SEQ ID NO:198, or SEQ ID NO:200; the CBDA synthase polypeptide comprises an amino acid sequence having at least 50% sequence identity to SEQ ID NO:88 or SEQ ID NO:151; the TKS polypeptide comprises an amino acid sequence having at least 50% sequence identity to SEQ ID NO:11 or SEQ ID NO:76; and the OAC polypeptide comprises an amino acid sequence having at least 50% sequence identity to SEQ ID NO:10 or SEQ ID NO:78.

The present disclosure provides a genetically modified host cell for producing a cannabinoid or a cannabinoid derivative, wherein the genetically modified host cell is genetically modified with: a) one or more heterologous nucleic acids that encode a GOT polypeptide; b) one or more heterologous nucleic acids that encode a polypeptide that generates GPP; c) one or more heterologous nucleic acids that encode one or more of the following polypeptides: a HMGS polypeptide, a tHMGR polypeptide, a MK polypeptide, a PMK polypeptide, a MVD polypeptide, or an IDI polypeptide; d) one or more heterologous nucleic acids that encode a polypeptide that condenses two molecules of acetyl-CoA to generate acetoacetyl-CoA; e) one or more heterologous nucleic acids that encode a PDC polypeptide; and f) one or more heterologous nucleic acids that encode a TKS polypeptide and one or more heterologous nucleic acids that encode an OAC polypeptide. In certain such embodiments, the GOT polypeptide can catalyze production of cannabigerolic acid from GPP and olivetolic acid in an amount at least ten times higher than a polypeptide comprising an amino acid sequence set forth in SEQ ID NO:82. In some embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:100 or SEQ ID NO:110. In certain such embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:110. In some embodiments, the polypeptide that generates GPP is a GPPS polypeptide and comprises an amino acid sequence having at least 50% sequence identity to SEQ ID NO:7, SEQ ID NO:8, or SEQ ID NO:60; the IDI polypeptide comprises an amino acid sequence having at least 50% sequence identity to SEQ ID NO:58; the tHMGR polypeptide comprises an amino acid sequence having at least 50% sequence identity to SEQ ID NO:17, SEQ ID NO:52, SEQ ID NO:113, or SEQ ID NO:208; the HMGS polypeptide comprises an amino acid sequence having at least 50% sequence identity to SEQ ID NO:23, SEQ ID NO:24, or SEQ ID NO:115; the MK polypeptide comprises an amino acid sequence having at least 50% sequence identity to SEQ ID NO:64; the PMK polypeptide comprises an amino acid sequence having at least 50% sequence identity to SEQ ID NO:62 or SEQ ID NO:205; the MVD polypeptide comprises an amino acid sequence having at least 50% sequence identity to SEQ ID NO:66; the polypeptide that condenses two molecules of acetyl-CoA to generate acetoacetyl-CoA is an acetoacetyl-CoA thiolase polypeptide and comprises an amino acid sequence having at least 50% sequence identity to SEQ ID NO:25; the PDC polypeptide comprises an amino acid sequence having at least 50% sequence identity to SEQ ID NO:117; the TKS polypeptide comprises an amino acid sequence having at least 50% sequence identity to SEQ ID NO:11 or SEQ ID NO:76; and the OAC polypeptide comprises an amino acid sequence having at least 50% sequence identity to SEQ ID NO:10 or SEQ ID NO:78.

The present disclosure provides a genetically modified host cell for producing a cannabinoid or a cannabinoid derivative, wherein the genetically modified host cell is genetically modified with: a) one or more heterologous nucleic acids that encode a GOT polypeptide; b) one or more heterologous nucleic acids that encode a polypeptide that generates GPP; c) one or more heterologous nucleic acids that encode a THCA synthase polypeptide; d) one or more heterologous nucleic acids that encode one or more of the following polypeptides: a HMGS polypeptide, a tHMGR polypeptide, a MK polypeptide, a PMK polypeptide, a MVD polypeptide, or an IDI polypeptide; e) one or more heterologous nucleic acids that encode a polypeptide that condenses two molecules of acetyl-CoA to generate acetoacetyl-CoA; f) a PDC polypeptide; and g) one or more heterologous nucleic acids that encode a TKS polypeptide and one or more heterologous nucleic acids that encode an OAC polypeptide. In certain such embodiments, the GOT polypeptide can catalyze production of cannabigerolic acid from GPP and olivetolic acid in an amount at least ten times higher than a polypeptide comprising an amino acid sequence set forth in SEQ ID NO:82. In some embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:100 or SEQ ID NO:110. In certain such embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:110. In some embodiments, the polypeptide that generates GPP is a GPPS polypeptide and comprises an amino acid sequence having at least 50% sequence identity to SEQ ID NO:7, SEQ ID NO:8, or SEQ ID NO:60; the IDI polypeptide comprises an amino acid sequence having at least 50% sequence identity to SEQ ID NO:58; the tHMGR polypeptide comprises an amino acid sequence having at least 50% sequence identity to SEQ ID NO:17, SEQ ID NO:52, SEQ ID NO:113, or SEQ ID NO:208; the HMGS polypeptide comprises an amino acid sequence having at least 50% sequence identity to SEQ ID NO:23, SEQ ID NO:24, or SEQ ID NO:115; the MK polypeptide comprises an amino acid sequence having at least 50% sequence identity to SEQ ID NO:64; the PMK polypeptide comprises an amino acid sequence having at least 50% sequence identity to SEQ ID NO:62 or SEQ ID NO:205; the MVD polypeptide comprises an amino acid sequence having at least 50% sequence identity to SEQ ID NO:66; the polypeptide that condenses two molecules of acetyl-CoA to generate acetoacetyl-CoA is an acetoacetyl-CoA thiolase polypeptide and comprises an amino acid sequence having at least 50% sequence identity to SEQ ID NO:25; the PDC polypeptide comprises an amino acid sequence having at least 50% sequence identity to SEQ ID NO:117; the THCA synthase polypeptide comprises an amino acid sequence having at least 50% sequence identity to SEQ ID NO:14, SEQ ID NO:86, SEQ ID NO:104, SEQ ID NO:153, or SEQ ID NO:155; the TKS polypeptide comprises an amino acid sequence having at least 50% sequence identity to SEQ ID NO:11 or SEQ ID NO:76; and the OAC polypeptide comprises an amino acid sequence having at least 50% sequence identity to SEQ ID NO:10 or SEQ ID NO:78.

The present disclosure provides a genetically modified host cell for producing a cannabinoid or a cannabinoid derivative, wherein the genetically modified host cell is genetically modified with: a) one or more heterologous nucleic acids that encode a GOT polypeptide; b) one or more heterologous nucleic acids that encode a polypeptide that generates GPP; c) one or more heterologous nucleic acids that encode a CBDA synthase polypeptide; d) one or more heterologous nucleic acids that encode one or more of the following polypeptides: a HMGS polypeptide, a tHMGR polypeptide, a MK polypeptide, a PMK polypeptide, a MVD polypeptide, or an IDI polypeptide; e) one or more heterologous nucleic acids that encode a polypeptide that condenses two molecules of acetyl-CoA to generate acetoacetyl-CoA; f) one or more heterologous nucleic acids that encode a PDC polypeptide; and g) one or more heterologous nucleic acids that encode a TKS polypeptide and one or more heterologous nucleic acids that encode an OAC polypeptide. In certain such embodiments, the GOT polypeptide can catalyze production of cannabigerolic acid from GPP and olivetolic acid in an amount at least ten times higher than a polypeptide comprising an amino acid sequence set forth in SEQ ID NO:82. In some embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:100 or SEQ ID NO:110. In certain such embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:110. In some embodiments, the polypeptide that generates GPP is a GPPS polypeptide and comprises an amino acid sequence having at least 50% sequence identity to SEQ ID NO:7, SEQ ID NO:8, or SEQ ID NO:60; the IDI polypeptide comprises an amino acid sequence having at least 50% sequence identity to SEQ ID NO:58; the tHMGR polypeptide comprises an amino acid sequence having at least 50% sequence identity to SEQ ID NO:17, SEQ ID NO:52, SEQ ID NO:113, or SEQ ID NO:208; the HMGS polypeptide comprises an amino acid sequence having at least 50% sequence identity to SEQ ID NO:23, SEQ ID NO:24, or SEQ ID NO:115; the MK polypeptide comprises an amino acid sequence having at least 50% sequence identity to SEQ ID NO:64; the PMK polypeptide comprises an amino acid sequence having at least 50% sequence identity to SEQ ID NO:62 or SEQ ID NO:205; the MVD polypeptide comprises an amino acid sequence having at least 50% sequence identity to SEQ ID NO:66; the polypeptide that condenses two molecules of acetyl-CoA to generate acetoacetyl-CoA is an acetoacetyl-CoA thiolase polypeptide and comprises an amino acid sequence having at least 50% sequence identity to SEQ ID NO:25; the PDC polypeptide comprises an amino acid sequence having at least 50% sequence identity to SEQ ID NO:117; the CBDA synthase polypeptide comprises an amino acid sequence having at least 50% sequence identity to SEQ ID NO:88 or SEQ ID NO:151; the TKS polypeptide comprises an amino acid sequence having at least 50% sequence identity to SEQ ID NO:11 or SEQ ID NO:76; and the OAC polypeptide comprises an amino acid sequence having at least 50% sequence identity to SEQ ID NO:10 or SEQ ID NO:78.

The present disclosure provides a genetically modified host cell for producing a cannabinoid or a cannabinoid derivative, wherein the genetically modified host cell is genetically modified with: a) one or more heterologous nucleic acids that encode a GOT polypeptide; b) one or more heterologous nucleic acids that encode a polypeptide that generates GPP; c) one or more heterologous nucleic acids that encode one or more of the following polypeptides: a HMGS polypeptide, a tHMGR polypeptide, a MK polypeptide, a PMK polypeptide, a MVD polypeptide, or an IDI polypeptide; d) one or more heterologous nucleic acids that encode a polypeptide that condenses two molecules of acetyl-CoA to generate acetoacetyl-CoA; e) one or more heterologous nucleic acids that encode a PDC polypeptide; f) one or more heterologous nucleic acids that encode a TKS polypeptide and one or more heterologous nucleic acids that encode an OAC polypeptide; g) one or more heterologous nucleic acids that encode a polypeptide that generates malonyl-CoA; and h) one or more heterologous nucleic acids that encode a polypeptide that generates an acyl-CoA compound or an acyl-CoA compound derivative. In certain such embodiments, the GOT polypeptide can catalyze production of cannabigerolic acid from GPP and olivetolic acid in an amount at least ten times higher than a polypeptide comprising an amino acid sequence set forth in SEQ ID NO:82. In some embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:100 or SEQ ID NO:110. In certain such embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:110. In some embodiments, the polypeptide that generates GPP is a GPPS polypeptide and comprises an amino acid sequence having at least 50% sequence identity to SEQ ID NO:7, SEQ ID NO:8, or SEQ ID NO:60; the polypeptide comprises an amino acid sequence having at least 50% sequence identity to SEQ ID NO:58; the tHMGR polypeptide comprises an amino acid sequence having at least 50% sequence identity to SEQ ID NO:17, SEQ ID NO:52, SEQ ID NO:113, or SEQ ID NO:208; the HMGS polypeptide comprises an amino acid sequence having at least 50% sequence identity to SEQ ID NO:23, SEQ ID NO:24, or SEQ ID NO:115; the MK polypeptide comprises an amino acid sequence having at least 50% sequence identity to SEQ ID NO:64; the PMK polypeptide comprises an amino acid sequence having at least 50% sequence identity to SEQ ID NO:62 or SEQ ID NO:205; the MVD polypeptide comprises an amino acid sequence having at least 50% sequence identity to SEQ ID NO:66; the polypeptide that condenses two molecules of acetyl-CoA to generate acetoacetyl-CoA is an acetoacetyl-CoA thiolase polypeptide and comprises an amino acid sequence having at least 50% sequence identity to SEQ ID NO:25; the polypeptide that generates an acyl-CoA compound or an acyl-CoA compound derivative comprises an amino acid sequence having at least 50% sequence identity to SEQ ID NO:90, SEQ ID NO:92, SEQ ID NO:145, SEQ ID NO:147, SEQ ID NO:149, SEQ ID NO:169, SEQ ID NO:192, SEQ ID NO:194, SEQ ID NO:196, SEQ ID NO:198, or SEQ ID NO:200; the PDC polypeptide comprises an amino acid sequence having at least 50% sequence identity to SEQ ID NO:117; the polypeptide that generates malonyl-CoA is an ACC polypeptide and comprises an amino acid sequence having at least 50% sequence identity to SEQ ID NO:9, SEQ ID NO:97, or SEQ ID NO:207; the TKS polypeptide comprises an amino acid sequence having at least 50% sequence identity to SEQ ID NO:11 or SEQ ID NO:76; and the OAC polypeptide comprises an amino acid sequence having at least 50% sequence identity to SEQ ID NO:10 or SEQ ID NO:78.

The present disclosure provides a genetically modified host cell for producing a cannabinoid or a cannabinoid derivative, wherein the genetically modified host cell is genetically modified with: a) one or more heterologous nucleic acids that encode a GOT polypeptide; b) one or more heterologous nucleic acids that encode a polypeptide that generates GPP; c) one or more heterologous nucleic acids that encode a MCA synthase polypeptide; d) one or more heterologous nucleic acids that encode one or more of the following polypeptides: a HMGS polypeptide, a tHMGR polypeptide, a MK polypeptide, a PMK polypeptide, a MVD polypeptide, or an IDI polypeptide; e) one or more heterologous nucleic acids that encode a polypeptide that condenses two molecules of acetyl-CoA to generate acetoacetyl-CoA; f) one or more heterologous nucleic acids that encode a PDC polypeptide; g) one or more heterologous nucleic acids that encode a TKS polypeptide and one or more heterologous nucleic acids that encode an OAC polypeptide; h) one or more heterologous nucleic acids that encode a polypeptide that generates malonyl-CoA; and i) one or more heterologous nucleic acids that encode a polypeptide that generates an acyl-CoA compound or an acyl-CoA compound derivative. In certain such embodiments, the GOT polypeptide can catalyze production of cannabigerolic acid from GPP and olivetolic acid in an amount at least ten times higher than a polypeptide comprising an amino acid sequence set forth in SEQ ID NO:82, In some embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:100 or SEQ ID NO:110. In certain such embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:110. In some embodiments, the polypeptide that generates GPP is a GPPS polypeptide and comprises an amino acid sequence having at least 50% sequence identity to SEQ ID NO:7, SEQ ID NO:8, or SEQ ID NO:60; the IDI polypeptide comprises an amino acid sequence having at least 50% sequence identity to SEQ ID NO:58; the tHMGR polypeptide comprises an amino acid sequence having at least 50% sequence identity to SEQ ID NO:17, SEQ ID NO:52, SEQ ID NO:113, or SEQ ID NO:208; the HMGS polypeptide comprises an amino acid sequence having at least 50% sequence identity to SEQ ID NO:23, SEQ ID NO:24, or SEQ ID NO:115; the MK polypeptide comprises an amino acid sequence having at least 50% sequence identity to SEQ ID NO:64; the PMK polypeptide comprises an amino acid sequence having at least 50% sequence identity to SEQ ID NO:62 or SEQ ID NO:205; the MVD polypeptide comprises an amino acid sequence having at least 50% sequence identity to SEQ ID NO:66; the polypeptide that condenses two molecules of acetyl-CoA to generate acetoacetyl-CoA is an acetoacetyl-CoA thiolase polypeptide and comprises an amino acid sequence having at least 50% sequence identity to SEQ ID NO:25; the PDC polypeptide comprises an amino acid sequence having at least 50% sequence identity to SEQ ID NO:117; the polypeptide that generates an acyl-CoA compound or an acyl-CoA compound derivative comprises an amino acid sequence having at least 50% sequence identity to SEQ ID NO:90, SEQ ID NO:92, SEQ ID NO:145, SEQ ID NO:147, SEQ ID NO:149, SEQ ID NO:169, SEQ ID NO:192, SEQ ID NO:194, SEQ ID NO:196, SEQ ID NO:198, or SEQ ID NO:200; the THCA synthase polypeptide comprises an amino acid sequence having at least 50% sequence identity to SEQ ID NO:14, SEQ ID NO:86, SEQ ID NO:104, SEQ ID NO:153, or SEQ ID NO:155; the polypeptide that generates malonyl-CoA is an ACC polypeptide and comprises an amino acid sequence having at least 50% sequence identity to SEQ ID NO:9, SEQ ID NO:97, or SEQ ID NO:207; the TKS polypeptide comprises an amino acid sequence having at least 50% sequence identity to SEQ ID NO:11 or SEQ ID NO:76; and the OAC polypeptide comprises an amino acid sequence having at least 50% sequence identity to SEQ ID NO:10 or SEQ ID NO:78, The present disclosure provides a genetically modified host cell for producing a cannabinoid or a cannabinoid derivative, wherein the genetically modified host cell is genetically modified with: a) one or more heterologous nucleic acids that encode a GOT polypeptide; b) one or more heterologous nucleic acids that encode a polypeptide that generates GPP; c) one or more heterologous nucleic acids that encode a CBDA synthase polypeptide; d) one or more heterologous nucleic acids that encode one or more of the following polypeptides: a HMGS polypeptide, a tHMGR polypeptide, a MK polypeptide, a PMK polypeptide, a MVD polypeptide, or an IDI polypeptide; e) one or more heterologous nucleic acids that encode a polypeptide that condenses two molecules of acetyl-CoA to generate acetoacetyl-CoA; f) one or more heterologous nucleic acids that encode a PDC polypeptide; g) one or more heterologous nucleic acids that encode a TKS polypeptide and one or more heterologous nucleic acids that encode an OAC polypeptide; h) one or more heterologous nucleic acids that encode a polypeptide that generates malonyl-CoA; and i) one or more heterologous nucleic acids that encode a polypeptide that generates an acyl-CoA compound or an acyl-CoA compound derivative. In certain such embodiments, the GOT polypeptide can catalyze production of cannabigerolic acid from GPP and olivetolic acid in an amount at least ten times higher than a polypeptide, comprising an amino acid sequence set forth in SEQ ID NO:82, In some embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:100 or SEQ ID NO:110. In certain such embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:110. In some embodiments, the polypeptide that generates GPP is a GPPS polypeptide and comprises an amino acid sequence having at least 50% sequence identity to SEQ ID NO:7, SEQ ID NO:8, or SEQ ID NO:60; the polypeptide comprises an amino acid sequence having at least 50% sequence identity to SEQ ID NO:58; the tHMGR polypeptide comprises an amino acid sequence having at least 50% sequence identity to SEQ ID NO:17, SEQ ID NO:52, SEQ ID NO:113, or SEQ ID NO:208; the HMGS polypeptide comprises an amino acid sequence having at least 50% sequence identity to SEQ ID NO:23, SEQ ID NO:24, or SEQ ID NO:115; the MK polypeptide comprises an amino acid sequence having at least 50% sequence identity to SEQ ID NO:64; the PMK polypeptide comprises an amino acid sequence having at least 50% sequence identity to SEQ ID NO:62 or SEQ ID NO:205; the MVD polypeptide comprises an amino acid sequence having at least 50% sequence identity to SEQ ID NO:66; the polypeptide that condenses two molecules of acetyl-CoA to generate acetoacetyl-CoA is an acetoacetyl-CoA thiolase polypeptide and comprises an amino acid sequence having at least 50% sequence identity to SEQ ID NO:25; the PDC polypeptide comprises an amino acid sequence having at least 50% sequence identity to SEQ ID NO:117; the polypeptide that generates an acyl-CoA compound or an acyl-CoA compound derivative comprises an amino acid sequence having at least 50% sequence identity to SEQ ID NO:90, SEQ ID NO:92, SEQ ID NO:145, SEQ ID NO:147, SEQ ID NO:149, SEQ ID NO:169, SEQ ID NO:192, SEQ ID NO:194, SEQ ID NO:196, SEQ ID NO:198, or SEQ ID NO:200; the CBDA synthase polypeptide comprises an amino acid sequence having at least 50% sequence identity to SEQ ID NO:88 or SEQ ID NO:151; the polypeptide that generates malonyl-CoA is an ACC polypeptide and comprises an amino acid sequence having at least 50% sequence identity to SEQ ID NO:9, SEQ ID NO:97, or SEQ ID NO:207; the TKS polypeptide comprises an amino acid sequence having at least 50% sequence identity to SEQ ID NO:11 or SEQ ID NO:76; and the OAC polypeptide comprises an amino acid sequence having at least 50% sequence identity to SEQ ID NO:10 or SEQ ID NO:78.

The present disclosure provides a genetically modified host cell for producing a cannabinoid or a cannabinoid derivative, wherein the genetically modified host cell is genetically modified with: a) one or more heterologous nucleic acids that encode a GOT polypeptide; b) one or more heterologous nucleic acids that encode a polypeptide that generates GPP; c) one or more heterologous nucleic acids that encode one or more of the following polypeptides: a HMGS polypeptide, a tHMGR polypeptide, a MK polypeptide, a PMK polypeptide, a MVD polypeptide, or an IDI polypeptide; d) one or more heterologous nucleic acids that encode a polypeptide that condenses two molecules of acetyl-CoA to generate acetoacetyl-CoA; e) one or more heterologous nucleic acids that encode a PDC polypeptide; f) one or more heterologous nucleic acids that encode a polypeptide that generates malonyl-CoA; and g) one or more heterologous nucleic acids that encode a TKS polypeptide and one or more heterologous nucleic acids that encode an OAC polypeptide. In certain such embodiments, the GOT polypeptide can catalyze production of cannabigerolic acid from GPP and olivetolic acid in an amount at least ten times higher than a polypeptide comprising an amino acid sequence set forth in SEQ ID NO:82. In some embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:100 or SEQ ID NO:110. In certain such embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:110. In some embodiments, the polypeptide that generates GPP is a GPPS polypeptide and comprises an amino acid sequence having at least 50% sequence identity to SEQ ID NO:7, SEQ ID NO:8, or SEQ ID NO:60; the IDI polypeptide comprises an amino acid sequence having at least 50% sequence identity to SEQ ID NO:58; the tHMGR polypeptide comprises an amino acid sequence having at least 50% sequence identity to SEQ ID NO:17, SEQ ID NO:52, SEQ ID NO:113, or SEQ ID NO:208; the HMGS polypeptide comprises an amino acid sequence having at least 50% sequence identity to SEQ ID NO:23, SEQ ID NO:24, or SEQ ID NO:115; the MK polypeptide comprises an amino acid sequence having at least 50% sequence identity to SEQ ID NO:64; the PMK polypeptide comprises an amino acid sequence having at least 50% sequence identity to SEQ ID NO:62 or SEQ ID NO:205; the MVD polypeptide comprises an amino acid sequence having at least 50% sequence identity to SEQ ID NO:66; the polypeptide that condenses two molecules of acetyl-CoA to generate acetoacetyl-CoA is an acetoacetyl-CoA thiolase polypeptide and comprises an amino acid sequence having at least 50% sequence identity to SEQ ID NO:25; the PDC polypeptide comprises an amino acid sequence having at least 50% sequence identity to SEQ ID NO:117; the polypeptide that generates malonyl-CoA is an ACC polypeptide and comprises an amino acid sequence having at least 50% sequence identity to SEQ ID NO:9, SEQ ID NO:97, or SEQ ID NO:207; the TKS polypeptide comprises an amino acid sequence having at least 50% sequence identity to SEQ ID NO:11 or SEQ ID NO:76; and the OAC polypeptide comprises an amino acid sequence having at least 50% sequence identity to SEQ ID NO:10 or SEQ ID NO:78.

The present disclosure provides a genetically modified host cell for producing a cannabinoid or a cannabinoid derivative, wherein the genetically modified host cell is genetically modified with: a) one or more heterologous nucleic acids that encode a GOT polypeptide; b) one or more heterologous nucleic acids that encode a polypeptide that generates GPP; c) one or more heterologous nucleic acids that encode a THCA synthase polypeptide; d) one or more heterologous nucleic acids that encode one or more of the following polypeptides: a HMGS polypeptide, a tHMGR polypeptide, a MK polypeptide, a PMK polypeptide, a MVD polypeptide, or an IDI polypeptide; e) one or more heterologous nucleic acids that encode a polypeptide that condenses two molecules of acetyl-CoA to generate acetoacetyl-CoA; f) one or more heterologous nucleic acids that encode a PDC polypeptide; g) one or more heterologous nucleic acids that encode a polypeptide that generates malonyl-CoA; and h) one or more heterologous nucleic acids that encode a TKS polypeptide and one or more heterologous nucleic acids that encode an OAC polypeptide. In certain such embodiments, the GOT polypeptide can catalyze production of cannabigerolic acid from GPP and olivetolic acid in an amount at least ten times higher than a polypeptide comprising an amino acid sequence set forth in SEQ ID NO:82. In some embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:100 or SEQ ID NO:110. In certain such embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:110. In some embodiments, the polypeptide that generates GPP is a GPPS polypeptide and comprises an amino acid sequence having at least 50% sequence identity to SEQ ID NO:7, SEQ ID NO:8, or SEQ ID NO:60; the IDI polypeptide comprises an amino acid sequence having at least 50% sequence identity to SEQ ID NO:58; the tHMGR polypeptide comprises an amino acid sequence having at least 50% sequence identity to SEQ ID NO:17, SEQ ID NO:52, SEQ ID NO:113, or SEQ ID NO:208; the HMGS polypeptide comprises an amino acid sequence having at least 50% sequence identity to SEQ ID NO:23, SEQ ID NO:24, or SEQ ID NO:115; the MK polypeptide comprises an amino acid sequence having at least 50% sequence identity to SEQ ID NO:64; the PMK polypeptide comprises an amino acid sequence having at least 50% sequence identity to SEQ ID NO:62 or SEQ ID NO:205; the MVD polypeptide comprises an amino acid sequence having at least 50% sequence identity to SEQ ID NO:66; the polypeptide that condenses two molecules of acetyl-CoA to generate acetoacetyl-CoA is an acetoacetyl-CoA thiolase polypeptide and comprises an amino acid sequence having at least 50% sequence identity to SEQ ID NO:25; the PDC polypeptide comprises an amino acid sequence having at least 50% sequence identity to SEQ ID NO:117; the THCA synthase polypeptide comprises an amino acid sequence having at least 50% sequence identity to SEQ ID NO:14, SEQ ID NO:86, SEQ ID NO:104, SEQ ID NO:153, or SEQ ID NO:155; the polypeptide that generates malonyl-CoA is an ACC polypeptide and comprises an amino acid sequence having at least 50% sequence identity to SEQ ID NO:9, SEQ ID NO:97, or SEQ ID NO:207; the TKS polypeptide comprises an amino acid sequence having at least 50% sequence identity to SEQ ID NO:11 or SEQ ID NO:76; and the OAC polypeptide comprises an amino acid sequence having at least 50% sequence identity to SEQ ID NO:10 or SEQ ID NO:78.

The present disclosure provides a genetically modified host cell for producing a cannabinoid or a cannabinoid derivative, wherein the genetically modified host cell is genetically modified with: a) one or more heterologous nucleic acids that encode a GOT polypeptide; b) one or more heterologous nucleic acids that encode a polypeptide that generates GPP; c) one or more heterologous nucleic acids that encode a CBDA synthase polypeptide; d) one or more heterologous nucleic acids that encode one or more of the following polypeptides: a HMGS polypeptide, a tHMGR polypeptide, a MK polypeptide, a PMK polypeptide, a MVD polypeptide, or an polypeptide; e) one or more heterologous nucleic acids that encode a polypeptide that condenses two molecules of acetyl-CoA to generate acetoacetyl-CoA; f) one or more heterologous nucleic acids that encode a PDC polypeptide; g) one or more heterologous nucleic acids that encode a polypeptide that generates malonyl-CoA; and h) one or more heterologous nucleic acids that encode a TKS polypeptide and one or more heterologous nucleic acids that encode an OAC polypeptide. In certain such embodiments, the GOT polypeptide can catalyze production of cannabigerolic acid from GPP and olivetolic acid in an amount at least ten times higher than a polypeptide comprising an amino acid sequence set forth in SEQ ID NO:82. In some embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:100 or SEQ ID NO:110. In certain such embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:110. In some embodiments, the polypeptide that generates GPP is a GPPS polypeptide and comprises an amino acid sequence having at least 50% sequence identity to SEQ ID NO:7, SEQ ID NO:8, or SEQ ID NO:60; the polypeptide comprises an amino acid sequence having at least 50% sequence identity to SEQ ID NO:58; the tHMGR polypeptide comprises an amino acid sequence having at least 50% sequence identity to SEQ ID NO:17, SEQ ID NO:52, SEQ ID NO:113, or SEQ ID NO:208; the HMGS polypeptide comprises an amino acid sequence having at least 50% sequence identity to SEQ ID NO:23, SEQ ID NO:24, or SEQ ID NO:115; the MK polypeptide comprises an amino acid sequence having at least 50% sequence identity to SEQ ID NO:64; the PMK polypeptide comprises an amino acid sequence having at least 50% sequence identity to SEQ ID NO:62 or SEQ ID NO:205; the MVD polypeptide comprises an amino acid sequence having at least 50% sequence identity to SEQ ID NO:66; the polypeptide that condenses two molecules of acetyl-CoA to generate acetoacetyl-CoA is an acetoacetyl-CoA thiolase polypeptide and comprises an amino acid sequence having at least 50% sequence identity to SEQ ID NO:25; the PDC polypeptide comprises an amino acid sequence having at least 50% sequence identity to SEQ ID NO:117; the CBDA synthase polypeptide comprises an amino acid sequence having at least 50% sequence identity to SEQ ID NO:88 or SEQ ID NO:151; the polypeptide that generates malonyl-CoA is an ACC polypeptide and comprises an amino acid sequence having at least 50% sequence identity to SEQ ID NO:9, SEQ ID NO:97, or SEQ ID NO:207; the TKS polypeptide comprises an amino acid sequence having at least 50% sequence identity to SEQ ID NO:11 or SEQ ID NO:76; and the OAC polypeptide comprises an amino acid sequence having at least 50% sequence identity to SEQ ID NO:10 or SEQ ID NO:78.

The present disclosure provides a genetically modified host cell for producing a cannabinoid or a cannabinoid derivative, wherein the genetically modified host cell is genetically modified with: a) one or more heterologous nucleic acids that encode a polypeptide that generates an acyl-CoA compound or an acyl-CoA compound derivative; b) one or more heterologous nucleic acids that encode a polypeptide that generates GPP; c) one or more heterologous nucleic acids that encode a polypeptide that generates malonyl-CoA; d) one or more heterologous nucleic acids that encode one or more polypeptides that condense an acyl-CoA compound or an acyl-CoA compound derivative with malonyl-CoA to generate olivetolic acid or derivatives of olivetolic acid; e) one or more heterologous nucleic acids that encode a geranyl pyrophosphate:olivetolic acid transferase (GOT) polypeptide or an aromatic prenyltransferase polypeptide such as a NphB polypeptide; and f) one or more heterologous nucleic acids that encode a cannabinoid synthase polypeptide.

The present disclosure also provides a genetically modified host cell for producing a cannabinoid or a cannabinoid derivative, wherein the genetically modified host cell is genetically modified with: a) one or more heterologous nucleic acids that encode a polypeptide that generates an acyl-CoA compound or an acyl-CoA compound derivative; b) one or more heterologous nucleic acids that encode a polypeptide that generates neryl pyrophosphate (NPP); c) one or more heterologous nucleic acids that encode a polypeptide that generates malonyl-CoA; d) one or more heterologous nucleic acids that encode one or more polypeptides that condense an acyl-CoA compound or an acyl-CoA compound derivative and malonyl-CoA to generate olivetolic acid or derivatives of olivetolic acid; e) one or more heterologous nucleic acids that encode a GOT polypeptide or a NphB polypeptide; and f) one or more heterologous nucleic acids that encode a cannabinoid synthase polypeptide. In certain such embodiments, culturing of the genetically modified host cell in a suitable medium provides for synthesis of the cannabinoid or the cannabinoid derivative in a recoverable amount.

The present disclosure provides a genetically modified host cell for producing a cannabinoid or a cannabinoid derivative, wherein the genetically modified host cell is genetically modified with: a) one or more heterologous nucleic acids that encode a polypeptide that generates an acyl-CoA compound or an acyl-CoA compound derivative; b) one or more heterologous nucleic acids that encode a TKS/OAC fusion polypeptide; and c) one or more heterologous nucleic acids that encode a GOT polypeptide or a NphB polypeptide. In certain such embodiments, culturing the genetically modified host cell in a medium comprising a carboxylic acid provides for synthesis of a cannabinoid derivative or cannabinoid in a recoverable amount. In some embodiments, the genetically modified host cell is further genetically modified with one or more heterologous nucleic acids that encode a THCAS or CBDAS polypeptide. In certain such embodiments, culturing the genetically modified host cell in a medium comprising a carboxylic acid provides for synthesis of a cannabinoid derivative or a cannabinoid in a recoverable amount.

Exemplary Genetically Modified Host Cells Expressing NPPS Polypeptides

In some embodiments, a genetically modified host cell of the present disclosure is genetically modified with: a) one or more heterologous nucleic acids encoding a polypeptide that condenses 2 molecules of acetyl-CoA to generate acetoacetyl-CoA; b) one or more heterologous nucleic acids encoding one or more mevalonate pathway polypeptides; and c) one or more heterologous nucleic acids encoding a NPPS polypeptide.

In some embodiments, a genetically modified host cell of the present disclosure is genetically modified with: a) one or more heterologous nucleic acids encoding a polypeptide that condenses 2 molecules of acetyl-CoA to generate acetoacetyl-CoA; b) one or more heterologous nucleic acids encoding one or more mevalonate pathway polypeptides; c) one or more heterologous nucleic acids encoding a NPPS polypeptide; and d) one or more heterologous nucleic acids encoding a TKS polypeptide and one or more heterologous nucleic acids encoding an OAC polypeptide.

In some embodiments, a genetically modified host cell of the present disclosure is genetically modified with: a) one or more heterologous nucleic acids encoding a polypeptide that condenses 2 molecules of acetyl-CoA to generate acetoacetyl-CoA; b) one or more heterologous nucleic acids encoding one or more mevalonate pathway polypeptides; c) one or more heterologous nucleic acids encoding a NPPS polypeptide; d) one or more heterologous nucleic acids encoding a polypeptide that generates an acyl-CoA compound or an acyl-CoA compound derivative; and e) one or more heterologous nucleic acids encoding a TKS polypeptide and one or more heterologous nucleic acids encoding an OAC polypeptide.

A GOT polypeptide, using NPP and olivetolic acid as substrates, can generate cannabinerolic acid (CBNRA). In some embodiments, a GOT polypeptide acts on NPP and an olivetolic acid derivative (as described elsewhere herein) to generate a CBNRA derivative. Cannabinerolic acid or derivatives thereof can serve as a substrate for a CBDAS or THCAS polypeptide to generate CBDA or THCA, or derivatives thereof, respectively.

In some embodiments, a genetically modified host cell of the present disclosure is genetically modified with: a) one or more heterologous nucleic acids encoding a polypeptide that condenses one molecule of acetyl-CoA and one molecule of malonyl-CoA to generate acetoacetyl-CoA; b) one or more heterologous nucleic acids encoding one or more mevalonate pathway polypeptides; c) one or more heterologous nucleic acids encoding a NPPS polypeptide; and d) one or more heterologous nucleic acids encoding a GOT polypeptide. In certain such embodiments, the GOT polypeptide encoded by one or more heterologous nucleic acids can catalyze production of cannabigerolic acid from GPP and olivetolic acid in an amount at least ten times higher than a polypeptide comprising an amino acid sequence set forth in SEQ ID NO:82. In some embodiments, the GOT polypeptide encoded by the one or more heterologous nucleic acids comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) amino acid sequence identity to SEQ ID NO:100 or SEQ ID NO:110. In certain such embodiments, the GOT polypeptide encoded by the one or more heterologous nucleic acids comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) amino acid sequence identity to SEQ ID NO:110.

In some embodiments, a genetically modified host cell of the present disclosure is genetically modified with: a) one or more heterologous nucleic acids encoding a polypeptide that condenses 2 molecules of acetyl-CoA to generate acetoacetyl-CoA; b) one or more heterologous nucleic acids encoding one or more mevalonate pathway polypeptides; c) one or more heterologous nucleic acids encoding a NPPS polypeptide; and d) one or more heterologous nucleic acids encoding a GOT polypeptide or a NphB polypeptide. In certain such embodiments, the GOT polypeptide encoded by one or more heterologous nucleic acids can catalyze production of cannabigerolic acid from GPP and olivetolic acid in an amount at least ten times higher than a polypeptide comprising an amino acid sequence set forth in SEQ ID NO:82. In some embodiments, the GOT polypeptide encoded by the one or more heterologous nucleic acids comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) amino acid sequence identity to SEQ ID NO:100 or SEQ ID NO:110. In certain such embodiments, the GOT polypeptide encoded by the one or more heterologous nucleic acids comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) amino acid sequence identity to SEQ ID NO:110.

In some embodiments, a genetically modified host cell of the present disclosure is genetically modified with: a) one or more heterologous nucleic acids encoding a polypeptide that condenses 2 molecules of acetyl-CoA to generate acetoacetyl-CoA; b) one or more heterologous nucleic acids encoding one or more mevalonate pathway polypeptides; c) one or more heterologous nucleic acids encoding a NPPS polypeptide; d) one or more heterologous nucleic acids encoding a GOT polypeptide or a NphB polypeptide; and e) one or more heterologous nucleic acids encoding a CBDAS or THCAS polypeptide. In certain such embodiments, the GOT polypeptide encoded by one or more heterologous nucleic acids can catalyze production of cannabigerolic acid from GPP and olivetolic acid in an amount at least ten times higher than a polypeptide comprising an amino acid sequence set forth in SEQ ID NO:82. In some embodiments, the GOT polypeptide encoded by the one or more heterologous nucleic acids comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) amino acid sequence identity to SEQ ID NO:100 or SEQ ID NO:110. In certain such embodiments, the GOT polypeptide encoded by the one or more heterologous nucleic acids comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) amino acid sequence identity to SEQ ID NO:110.

In some embodiments, a genetically modified host cell of the present disclosure is genetically modified with: a) one or more heterologous nucleic acids encoding a polypeptide that condenses one molecule of acetyl-CoA and one molecule of malonyl-CoA to generate acetoacetyl-CoA; b) one or more heterologous nucleic acids encoding one or more mevalonate pathway polypeptides; c) one or more heterologous nucleic acids encoding a NPPS polypeptide; d) one or more heterologous nucleic acids encoding a TKS polypeptide and one or more heterologous nucleic acids encoding an OAC polypeptide; and e) one or more heterologous nucleic acids encoding a GOT polypeptide. In certain such embodiments, the GOT polypeptide encoded by one or more heterologous nucleic acids can catalyze production of cannabigerolic acid from GPP and olivetolic acid in an amount at least ten times higher than a polypeptide comprising an amino acid sequence set forth in SEQ ID NO:82. In some embodiments, the GOT polypeptide encoded by the one or more heterologous nucleic acids comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) amino acid sequence identity to SEQ ID NO:100 or SEQ ID NO:110. In certain such embodiments, the GOT polypeptide encoded by the one or more heterologous nucleic acids comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) amino acid sequence identity to SEQ ID NO:110.

In some embodiments, a genetically modified host cell of the present disclosure is genetically modified with: a) one or more heterologous nucleic acids encoding a polypeptide that condenses 2 molecules of acetyl-CoA to generate acetoacetyl-CoA; b) one or more heterologous nucleic acids encoding one or more mevalonate pathway polypeptides; c) one or more heterologous nucleic acids encoding a NPPS polypeptide; d) one or more heterologous nucleic acids encoding a TKS polypeptide and one or more heterologous nucleic acids encoding an OAC polypeptide; and e) one or more heterologous nucleic acids encoding a GOT polypeptide or a NphB polypeptide. In certain such embodiments, the GOT polypeptide encoded by one or more heterologous nucleic acids can catalyze production of cannabigerolic acid from GPP and olivetolic acid in an amount at least ten times higher than a polypeptide comprising an amino acid sequence set forth in SEQ ID NO:82. In some embodiments, the GOT polypeptide encoded by the one or more heterologous nucleic acids comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) amino acid sequence identity to SEQ ID NO:100 or SEQ ID NO:110. In certain such embodiments, the GOT polypeptide encoded by the one or more heterologous nucleic acids comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) amino acid sequence identity to SEQ ID NO:110.

In some embodiments, a genetically modified host cell of the present disclosure is genetically modified with: a) one or more heterologous nucleic acids encoding a polypeptide that condenses 2 molecules of acetyl-CoA to generate acetoacetyl-CoA; b) one or more heterologous nucleic acids encoding one or more mevalonate pathway polypeptides; c) one or more heterologous nucleic acids encoding a NPPS polypeptide; d) one or more heterologous nucleic acids encoding a TKS polypeptide and one or more heterologous nucleic acids encoding an OAC polypeptide; e) one or more heterologous nucleic acids encoding a GOT polypeptide or a NphB polypeptide; and f) one or more heterologous nucleic acids encoding a CBDAS or THCAS polypeptide. In certain such embodiments, the GOT polypeptide encoded by one or more heterologous nucleic acids can catalyze production of cannabigerolic acid from GPP and olivetolic acid in an amount at least ten times higher than a polypeptide comprising an amino acid sequence set forth in SEQ ID NO:82. In some embodiments, the GOT polypeptide encoded by the one or more heterologous nucleic acids comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) amino acid sequence identity to SEQ ID NO:100 or SEQ ID NO:110. In certain such embodiments, the GOT polypeptide encoded by the one or more heterologous nucleic acids comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) amino acid sequence identity to SEQ ID NO:110.

In some embodiments, a genetically modified host cell of the present disclosure is genetically modified with: a) one or more heterologous nucleic acids encoding a polypeptide that condenses one molecule of acetyl-CoA and one molecule of malonyl-CoA to generate acetoacetyl-CoA; b) one or more heterologous nucleic acids encoding one or more mevalonate pathway polypeptides; c) one or more heterologous nucleic acids encoding a NPPS polypeptide; d) one or more heterologous nucleic acids encoding a TKS polypeptide and one or more heterologous nucleic acids encoding an OAC polypeptide; e) one or more heterologous nucleic acids encoding a polypeptide that generates an acyl-CoA compound or an acyl-CoA compound derivative; and f) one or more heterologous nucleic acids encoding a GOT polypeptide. In certain such embodiments, the GOT polypeptide encoded by one or more heterologous nucleic acids can catalyze production of cannabigerolic acid from GPP and olivetolic acid in an amount at least ten times higher than a polypeptide comprising an amino acid sequence set forth in SEQ ID NO:82. In some embodiments, the GOT polypeptide encoded by the one or more heterologous nucleic acids comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) amino acid sequence identity to SEQ ID NO:100 or SEQ ID NO:110. In certain such embodiments, the GOT polypeptide encoded by the one or more heterologous nucleic acids comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) amino acid sequence identity to SEQ ID NO:110.

In some embodiments, a genetically modified host cell of the present disclosure is genetically modified: a) with one or more heterologous nucleic acids encoding a polypeptide that condenses 2 molecules of acetyl-CoA to generate acetoacetyl-CoA; b) with one or more heterologous nucleic acids encoding one or more mevalonate pathway polypeptides; c) with one or more heterologous nucleic acids encoding a NPPS polypeptide; d) with one or more heterologous nucleic acids encoding a TKS polypeptide and with one or more heterologous nucleic acids encoding an OAC polypeptide; e) with one or more heterologous nucleic acids encoding a polypeptide that generates an acyl-CoA compound or an acyl-CoA compound derivative; and f with one or more heterologous nucleic acids encoding a GOT polypeptide or a NphB polypeptide. In certain such embodiments, the GOT polypeptide encoded by one or more heterologous nucleic acids can catalyze production of cannabigerolic acid from GPP and olivetolic acid in an amount at least ten times higher than a polypeptide comprising an amino acid sequence set forth in SEQ ID NO:82. In some embodiments, the GOT polypeptide encoded by the one or more heterologous nucleic acids comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) amino acid sequence identity to SEQ ID NO:100 or SEQ ID NO:110. In certain such embodiments, the GOT polypeptide encoded by the one or more heterologous nucleic acids comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) amino acid sequence identity to SEQ ID NO:110.

In some embodiments, a genetically modified host cell of the present disclosure is genetically modified with: a) one or more heterologous nucleic acids encoding a polypeptide that condenses 2 molecules of acetyl-CoA to generate acetoacetyl-CoA; b) one or more heterologous nucleic acids encoding one or more mevalonate pathway polypeptides; c) one or more heterologous nucleic acids encoding a NPPS polypeptide; d) one or more heterologous nucleic acids encoding a TKS polypeptide and one or more heterologous nucleic acids encoding an OAC polypeptide; e) one or more heterologous nucleic acids encoding a polypeptide that generates an acyl-CoA compound or an acyl-CoA compound derivative; f) one or more heterologous nucleic acids encoding a GOT polypeptide or a NphB polypeptide; and g) one or more heterologous nucleic acids encoding a CBDAS or THCAS polypeptide. In certain such embodiments, the GOT polypeptide encoded by one or more heterologous nucleic acids can catalyze production of cannabigerolic acid from GPP and olivetolic acid in an amount at least ten times higher than a polypeptide comprising an amino acid sequence set forth in SEQ ID NO:82. In some embodiments, the GOT polypeptide encoded by the one or more heterologous nucleic acids comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) amino acid sequence identity to SEQ ID NO:100 or SEQ ID NO:110. In certain such embodiments, the GOT polypeptide encoded by the one or more heterologous nucleic acids comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) amino acid sequence identity to SEQ ID NO:110.

Exemplary Genetically Modified Host Cells for Making Olivetolic Acid or Olivetolic Acid Derivatives The present disclosure provides a genetically modified host cell for producing olivetolic acid or an olivetolic acid derivative, wherein the genetically modified host cell is genetically modified with: a) one or more heterologous nucleic acids that encode a polypeptide that generates an acyl-CoA compound or an acyl-CoA compound derivative and b) one or more heterologous nucleic acids that encode a TKS polypeptide and one or more heterologous nucleic acids encoding an OAC polypeptide. In certain such embodiments, the polypeptide that generates an acyl-CoA compound or an acyl-CoA compound derivative comprises an amino acid sequence having at least 50% sequence identity to SEQ ID NO:90, SEQ ID NO:92, SEQ ID NO:145, SEQ ID NO:147, SEQ ID NO:149, SEQ ID NO:169, SEQ ID NO:192, SEQ ID NO:194, SEQ ID NO:196, SEQ ID NO:198, or SEQ ID NO:200; the TKS polypeptide comprises an amino acid sequence having at least 50% sequence identity to SEQ ID NO:11 or SEQ ID NO:76; and the OAC polypeptide comprises an amino acid sequence having at least 50% sequence identity to SEQ ID NO:10 or SEQ ID NO:78. In certain such embodiments, culturing the genetically modified host cell disclosed herein in a medium comprising a carboxylic acid provides for synthesis of an olivetolic acid or olivetolic acid derivative in a recoverable amount.

The present disclosure provides a genetically modified host cell for producing olivetolic acid or an olivetolic acid derivative, wherein the genetically modified host cell is genetically modified with: a) one or more heterologous nucleic acids that encode a polypeptide that generates an acyl-CoA compound or an acyl-CoA compound derivative; and b) one or more heterologous nucleic acids that encode a TKS/OAC fusion polypeptide. In certain such embodiments, culturing the genetically modified host cell in a medium comprising a carboxylic acid provides for synthesis of the olivetolic acid or olivetolic acid derivative in a recoverable amount.

Suitable Host Cells

Parent host cells that are suitable for use in generating a genetically modified host cell of the present disclosure may include prokaryotic cells and eukaryotic cells. In some embodiments, the eukaryotic cells are yeast cells. In some embodiments, the eukaryotic cells are plant cells.

Host cells (including parent host cells and genetically modified host cells) are in some embodiments unicellular organisms, or are grown in culture as single cells. In some embodiments, the host cell is a eukaryotic cell. Suitable eukaryotic host cells may include, but are not limited to, yeast cells, insect cells, plant cells, fungal cells, and algal cells. Suitable eukaryotic host cells may include, but are not limited to, *Pichia pastoris, Pichia finlandica, Pichia trehalophila, Pichia koclamae, Pichia membranaefaciens, Pichia opuntiae, Pichia thermotolerans, Pichia salictaria, Pichia guercuum, Pichia pijperi, Pichia stiptis, Pichia methanolica, Pichia* sp., *Saccharomyces cerevisiae, Saccharomyces* sp., *Hansenula polymorpha* (now known as *Pichia angusta*), *Kluyveromyces* sp., *Kluyveromyces lactis, Kluyveromyces marxianus, Schizosaccharomyces pompe, Dekkera bruxellensis, Arxula adeninivorans, Candida albicans, Aspergillus nidulans, Aspergillus niger, Aspergillus oryzae, Trichoderma reesei, Chrysosporium lucknowense, Fusarium* sp., *Fusarium gramineum, Fusarium venenatum, Neurospora crassa, Chlamydomonas reinhardtii*, and the like. In some embodiments, the host cell is a protease-deficient strain of *Saccharomyces cerevisiae*. In some embodiments, the host cell is a eukaryotic cell other than a plant cell. In some embodiments, the eukaryotic cell is a plant cell. In some embodiments, the eukaryotic cell is a plant cell, where the plant cell is one that does not normally produce a cannabinoid, a cannabinoid derivative, a cannabinoid precursor, or a cannabinoid precursor derivative. In some embodiments, the host cell is *Saccharomyces cerevisiae*. In some embodiments, the genetically modified host cell disclosed herein is cultured in vitro.

In some embodiments, the host cell is a prokaryotic cell. Suitable prokaryotic cells may include, but are not limited to, any of a variety of laboratory strains of *Escherichia coli, Lactobacillus* sp., *Salmonella* sp., *Shigella* sp., and the like. See, e.g., Carrier et al, (1992) *J. Immunol.* 148:1176-1181; U.S. Pat. No. 6,447,784; and Sizemore et al. (1995) *Science* 270:299-302. Examples of *Salmonella* strains which can be employed may include, but are not limited to, *Salmonella typhi* and *S. typhimurium*. Suitable *Shigella* strains may include, but are not limited to, *Shigella flexneri, Shigella sonnei*, and *Shigella disenteriae*. Typically, the laboratory strain is one that is non-pathogenic. Non-limiting examples of other suitable bacteria may include, but are not limited to, *Bacillus subtilis, Pseudomonas putida, Pseudomonas aeruginosa, Pseudomonas mevalonii, Rhodobacter sphaeroides, Rhodobacter capsulatus, Rhodospirillum rubrum, Rhodococcus* sp., and the like. In some embodiments, the host cell is *Escherichia coli*.

Genetic Modification of Host Cells

The present disclosure provides for a method of making a genetically modified host cell for producing a cannabinoid, a cannabinoid derivative, a cannabinoid precursor derivative, or a cannabinoid precursor, comprising introducing into the genetically modified host cell one or more heterologous nucleic acids disclosed herein. In some embodiments, the genetically modified host cell produces a cannabinoid or a cannabinoid derivative. The disclosure also provides a method for making a genetically modified host cell genetically modified to express or overexpress one or more heterologous nucleic acids disclosed herein that encode one or more polypeptides disclosed herein, comprising introducing into the genetically modified host cell one or more heterologous nucleic acids disclosed herein.

In some embodiments, the disclosure provides for a method of making a genetically modified host cell for producing a cannabinoid or a cannabinoid derivative, comprising introducing one or more heterologous nucleic acids encoding a GOT polypeptide, wherein said GOT polypeptide can catalyze production of cannabigerolic acid from GPP and olivetolic acid in an amount at least ten times higher than a polypeptide comprising an amino acid sequence set forth in SEQ ID NO:82, into the genetically modified host cell. In some embodiments, the present disclosure provides for a method of making a genetically modified host cell genetically modified to express or overexpress one or more heterologous nucleic acids encoding a GOT polypeptide, wherein said GOT polypeptide can catalyze production of cannabigerolic acid from GPP and olivetolic acid in an amount at least ten times higher than a polypeptide comprising an amino acid sequence set forth in SEQ ID NO:82, comprising introducing one or more heterologous nucleic acids encoding a GOT polypeptide, wherein said GOT polypeptide can catalyze production of cannabigerolic acid from GPP and olivetolic acid in an amount at least ten times higher than a polypeptide comprising an amino acid sequence set forth in SEQ ID NO:82, into the genetically modified host cell.

In some embodiments, the disclosure provides for a method of making a genetically modified host cell for producing a cannabinoid or a cannabinoid derivative, comprising introducing one or more heterologous nucleic acids encoding a GOT polypeptide comprising an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:110 into the genetically modified host cell. In some embodiments, the present disclosure provides for a method of making a genetically modified host cell genetically modified to express or overexpress one or more heterologous nucleic acids encoding a GOT polypeptide comprising an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:110 comprising introducing one or more heterologous nucleic acids encoding the GOT polypeptide comprising an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:110 into the genetically modified host cell.

The disclosure provides for a method of making a genetically modified host cell for producing a cannabinoid or a cannabinoid derivative, comprising introducing one or more heterologous nucleic acids encoding a GOT polypeptide, comprising an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:100 into the genetically modified host cell. In some embodiments, the present disclosure provides for a method of making a genetically modified host cell genetically modified to express or overexpress one or more heterologous nucleic acids encoding a GOT polypeptide comprising an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:100 comprising introducing one or more heterologous nucleic acids encoding the GOT polypeptide comprising an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:100 into the genetically modified host cell.

To genetically modify a parent host cell to produce a genetically modified host cell of the present disclosure, one or more heterologous nucleic acids disclosed herein is introduced stably or transiently into a host cell, using established techniques. Such techniques may include, but are not limited to, electroporation, calcium phosphate precipitation, DEAE-dextran mediated transfection, liposome-mediated transfection, and the like. For stable transformation, a heterologous nucleic acid will generally further include a selectable marker, e.g., any of several well-known selectable markers such as neomycin resistance, ampicillin resistance, tetracycline resistance, chloramphenicol resistance, kanamycin resistance, and the like. In some embodiments, a parent host cell is genetically modified to produce a genetically modified host cell of the present disclosure using a CRISPR/Cas9 system to genetically modify a parent host cell with one or more heterologous nucleic acids disclosed herein.

One or more nucleic acids disclosed herein can be present in an expression vector or construct. Suitable expression vectors may include, but are not limited to, baculovirus vectors, bacteriophage vectors, plasmids, phagemids, cosmids, fosmids, bacterial artificial chromosomes, viral vectors (e.g. viral vectors based on vaccinia virus, adenovirus, adeno-associated virus, SV40, herpes simplex virus, and the like), P1-based artificial chromosomes, yeast plasmids, yeast artificial chromosomes, and any other vectors specific for specific hosts of interest (such as E. coli and yeast). Thus, for example, one or more nucleic acids encoding a mevalonate pathway gene product(s) is included in any one of a variety of expression vectors for expressing the mevalonate pathway gene product(s). Such vectors may include chromosomal, non-chromosomal, and synthetic DNA sequences.

Numerous additional suitable expression vectors are known to those of skill in the art, and many are commercially available. The following vectors are provided by way of example; for bacterial host cells: pQE vectors (Qiagen), pBluescript plasmids, pNH vectors, lambda-ZAP vectors (Stratagene); pTrc99a, pKK223-3, pDR540, and pRIT2T (Pharmacia); for eukaryotic host cells: pXT1, pSG5 (Stratagene), pSVK3, pBPV, pMSG, and pSVLSV40 (Pharmacia). However, any other plasmid or other vector may be used so long as it is compatible with the host cell.

In some embodiments, one or more of the nucleic acids disclosed herein are present in a single expression vector. In some embodiments, two or more of the nucleic acids disclosed herein are present in a single expression vector. In some embodiments, three or more of the nucleic acids disclosed herein are present in a single expression vector. In some embodiments, four or more of the nucleic acids disclosed herein are present in a single expression vector. In some embodiments, five or more of the nucleic acids disclosed herein are present in a single expression vector. In some embodiments, six or more of the nucleic acids disclosed herein are present in a single expression vector. In some embodiments, seven or more of the nucleic acids disclosed herein are present in a single expression vector.

In some embodiments, two or more nucleic acids disclosed herein are in separate expression vectors. In some embodiments, three or more nucleic acids disclosed herein are in separate expression vectors. In some embodiments, four or more nucleic acids disclosed herein are in separate expression vectors. In some embodiments, five or more nucleic acids disclosed herein are in separate expression vectors. In some embodiments, six or more nucleic acids disclosed herein are in separate expression vectors. In some embodiments, seven or more nucleic acids disclosed herein are in separate expression vectors. In some embodiments, eight or more nucleic acids disclosed herein are in separate expression vectors. In some embodiments, nine or more nucleic acids disclosed herein are in separate expression vectors. In some embodiments, ten or more nucleic acids disclosed herein are in separate expression vectors.

In some embodiments, one or more of the nucleic acids disclosed herein are present in a single expression construct. In some embodiments, two or more of the nucleic acids disclosed herein are present in a single expression construct. In some embodiments, three or more of the nucleic acids disclosed herein are present in a single expression construct. In some embodiments, four or more of the nucleic acids disclosed herein are present in a single expression construct. In some embodiments, five or more of the nucleic acids disclosed herein are present in a single expression construct. In some embodiments, six or more of the nucleic acids disclosed herein are present in a single expression construct. In some embodiments, seven or more of the nucleic acids disclosed herein are present in a single expression construct.

In some embodiments, two or more nucleic acids disclosed herein are in separate expression constructs. In some embodiments, three or more nucleic acids disclosed herein are in separate expression constructs. In some embodiments, four or more nucleic acids disclosed herein are in separate expression constructs. In some embodiments, five or more nucleic acids disclosed herein are in separate expression constructs. In some embodiments, six or more nucleic acids disclosed herein are in separate expression constructs. In some embodiments, seven or more nucleic acids disclosed herein are in separate expression constructs. In some embodiments, eight or more nucleic acids disclosed herein are in separate expression constructs. In some embodiments, nine or more nucleic acids disclosed herein are in separate expression constructs. In some embodiments, ten or more nucleic acids disclosed herein are in separate expression constructs.

The disclosure provides a method of making a genetically modified host cell for producing a cannabinoid or a cannabinoid derivative, comprising introducing a vector comprising one or more heterologous nucleic acids encoding a GOT polypeptide, wherein said GOT polypeptide can catalyze production of cannabigerolic acid from GPP and olivetolic acid in an amount at least ten times higher than a polypeptide comprising an amino acid sequence set forth in SEQ ID NO:82, into the genetically modified host cell. The disclosure provides a method of making a genetically modified host cell for producing a cannabinoid or a cannabinoid derivative, comprising introducing a vector comprising one or more heterologous nucleic acids encoding a GOT polypeptide comprising an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:110 into the genetically modified host cell. The disclosure also provides a method of making a genetically modified host cell for producing a cannabinoid or a cannabinoid derivative, comprising introducing a vector comprising one or more heterologous nucleic acids encoding a GOT polypeptide comprising an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:100 into the genetically modified host cell.

The disclosure also provides a method of making a genetically modified host cell for producing a cannabinoid or a cannabinoid derivative, comprising introducing a vector comprising a CsPT4 heterologous nucleic acid comprising a nucleotide sequence having at least 80% sequence identity to SEQ ID NO:111 into the genetically modified host cell. The disclosure also provides a method of making a genetically modified host cell for producing a cannabinoid or a cannabinoid derivative, comprising introducing a vector comprising a CsPT4 heterologous nucleic acid comprising a nucleotide sequence having at least 80% sequence identity to SEQ ID NO:225 into the genetically modified host cell. The disclosure also provides a method of making a genetically modified host cell for producing a cannabinoid or a cannabinoid derivative, comprising introducing a vector comprising a CsPT4t heterologous nucleic acid comprising a nucleotide sequence having at least 80% sequence identity to SEQ ID NO:221 into the genetically modified host cell. The disclosure also provides a method of making a genetically modified host cell for producing a cannabinoid or a cannabinoid derivative, comprising introducing a vector comprising a CsPT4t heterologous nucleic acid comprising a nucleotide sequence having at least 80% sequence identity to SEQ ID NO:224 into the genetically modified host cell.

The disclosure provides a method of making a genetically modified host cell genetically modified to express or overexpress one or more heterologous nucleic acids encoding a GOT polypeptide, wherein said GOT polypeptide can catalyze production of cannabigerolic acid from GPP and olivetolic acid in an amount at least ten times higher than a polypeptide comprising an amino acid sequence set forth in SEQ ID NO:82, comprising introducing a vector comprising one or more heterologous nucleic acids encoding a GOT polypeptide, wherein said GOT polypeptide can catalyze production of cannabigerolic acid from GPP and olivetolic acid in an amount at least ten times higher than a polypeptide comprising an amino acid sequence set forth in SEQ ID NO:82, into the genetically modified host cell. The disclosure provides a method of making a genetically modified host cell genetically modified to express or overexpress one or more heterologous nucleic acids encoding a GOT polypeptide comprising an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:110, comprising introducing a vector comprising one or more heterologous nucleic acids encoding the GOT polypeptide comprising an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:110 into the genetically modified host cell. The disclosure provides a method of making a genetically modified host cell genetically modified to express or overexpress one or more heterologous nucleic acids encoding a GOT polypeptide comprising an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:100, comprising introducing a vector comprising one or more heterologous nucleic acids encoding the GOT polypeptide comprising an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:100 into the genetically modified host cell.

The disclosure also provides a method of making a genetically modified host cell genetically modified to express or overexpress a CsPT4 heterologous nucleic acid comprising a nucleotide sequence having at least 80% sequence identity to SEQ ID NO: 111, comprising introducing a vector comprising a CsPT4 heterologous nucleic acid comprising a nucleotide sequence having at least 80% sequence identity to SEQ ID NO:111 into the genetically modified host cell. The disclosure also provides a method of making a genetically modified host cell genetically modified to express or overexpress a CsPT4 heterologous nucleic acid comprising a nucleotide sequence having at least 80% sequence identity to SEQ ID NO:225, comprising introducing a vector comprising a CsPT4 heterologous nucleic acid comprising a nucleotide sequence having at least 80% sequence identity to SEQ ID NO:225 into the genetically modified host cell. The disclosure also provides a method of making a genetically modified host cell genetically modified to express or overexpress a CsPT4t heterologous nucleic acid comprising a nucleotide sequence having at least 80% sequence identity to SEQ ID NO:221, comprising introducing a vector comprising a CsPT4t heterologous nucleic acid comprising a nucleotide sequence having at least 80% sequence identity to SEQ ID NO:221 into the genetically modified host cell. The disclosure also provides a method of making a genetically modified host cell genetically modified to express or overexpress a CsPT4t heterologous nucleic acid comprising a nucleotide sequence having at least 80% sequence identity to SEQ ID NO:224, comprising introducing a vector comprising a CsPT4t heterologous nucleic acid comprising a nucleotide sequence having at least 80% sequence identity to SEQ ID NO:224 into the genetically modified host cell.

In some embodiments, one or more of the heterologous nucleic acids disclosed herein is present in a high copy number plasmid, e.g., a plasmid that exists in about 10-50 copies per cell, or more than 50 copies per cell. In some embodiments, one or more of the heterologous nucleic acids disclosed herein is present in a low copy number plasmid. In some embodiments, one or more of the heterologous nucleic acids disclosed herein is present in a medium copy number plasmid.

Depending on the host/vector or host/construct system utilized, any of a number of suitable transcription and translation control elements, including constitutive and inducible promoters, transcription enhancer elements, transcription terminators, etc. may be used in the expression vector or construct (see e.g., Bitter et al. (1987) *Methods in Enzymology,* 153:516-544).

In some embodiments, heterologous nucleic acids disclosed herein are operably linked to a promoter. In some embodiments, the promoter is a constitutive promoter. In some embodiments, the promoter is an inducible promoter. In some embodiments, the promoter is functional in a prokaryotic cell. In some embodiments, the promoter is functional in a eukaryotic cell. In some embodiments, the promoter can be a strong driver of expression. In some embodiments, the promoter can be a weak driver of expression. In some embodiments, the promoter can be a medium driver of expression.

Suitable promoters for use in prokaryotic host cells may include, but are not limited to, a bacteriophage T7 RNA polymerase promoter; a trp promoter; a lac operon promoter; a hybrid promoter, e.g., a lac/tac hybrid promoter, a tac/trc hybrid promoter, a trp/lac promoter, a T7/lac promoter; a trc promoter; a tac promoter, and the like; an araBAD promoter; in vivo regulated promoters, such as an ssaG promoter or a related promoter (see, e.g., U.S. Patent Publication No. 20040131637), a pagC promoter (Pulkkinen and Miller, *J. Bacteriol.,* 1991: 173(1): 86-93; Alpuche-Aranda et al., PNAS, 1992; 89(21): 10079-83), a nirB promoter (Harborne et al. (1992) *Mol. Micro.* 6:2805-2813), and the like (see, e.g., Dunstan et al. (1999) *Infect. Immun.* 67:5133-5141; McKelvie et al. (2004) *Vaccine* 22:3243-3255; and Chatfield et al. (1992) *Biotechnol.* 10:888-892); a sigma70 promoter, e.g., a consensus sigma70 promoter (see, e.g., GenBank Accession Nos. AX798980, AX798961, and AX798183); a stationary phase promoter, e.g., a dps promoter, a spv promoter, and the like; a promoter derived from the pathogenicity island SPI-2 (see, e.g., WO96/17951); an actA promoter (see, e.g., Shetron-Rama et al. (2002) *Infect. Immun.* 70:1087-1096); an rpsM promoter (see, e.g., Valdivia and Falkow (1996). *Mol. Microbiol.* 22:367-378); a tet promoter (see, e.g., Hillen, W. and Wissmann, A. (1989) In Saenger, W. and Heinemann, U. (eds), *Topics in Molecular and Structural Biology, Protein—Nucleic Acid Interaction.* Macmillan, London, UK, Vol. 10, pp. 143-162); an SP6 promoter (see, e.g., Melton et al. (1984) *Nucl. Acids Res.* 12:7035); and the like.

Suitable constitutive promoters for use in prokaryotic cells are known in the art and may also include, but are not limited to, a sigma70 promoter, e.g., a consensus sigma70 promoter.

Non-limiting examples of suitable eukaryotic promoters may include CMV immediate early, HSV thymidine kinase, early and late SV40, LTRs from retrovirus, and mouse metallothionein-I. Selection of the appropriate vector, construct, and promoter is well within the level of ordinary skill in the art. The expression vector or construct may also contain a ribosome binding site for translation initiation and a transcription terminator. The expression vector or construct may also include appropriate sequences for amplifying expression.

In yeast, a number of vectors or constructs containing constitutive or inducible promoters may be used. For a review see, Current Protocols in Molecular Biology, Vol. 2, 1988, Ed. Ausubel, et al., Greene Publish. Assoc. & Wiley Interscience, Ch. 13; Grant, et al., 1987, Expression and Secretion Vectors for Yeast, in Methods in Enzymology, Eds. Wu & Grossman, 31987, Acad. Press, N.Y., Vol. 153, pp. 516-544; Glover, 1986, DNA Cloning, Vol. II, IRL Press, Wash., D.C., Ch. 3; and Bitter, 1987, Heterologous Gene Expression in Yeast, Methods in Enzymology, Eds. Berger & Kimmel, Acad. Press, N.Y., Vol. 152, pp. 673-684; and The Molecular Biology of the Yeast Saccharomyces, 1982, Eds. Strathern et al., Cold Spring Harbor Press, Vols. I and II. A constitutive yeast promoter such as ADH or LEU2 or an inducible promoter such as GAL may be used (Cloning in Yeast, Ch. 3, R. Rothstein In: DNA Cloning Vol. 11, A Practical Approach, Ed. D M Glover, 1986, IRL Press, Wash., D.C.). Alternatively, vectors may be used which promote integration of foreign DNA sequences into the yeast chromosome.

Generally, recombinant expression vectors will include origins of replication and selectable markers permitting transformation of the host cell, e.g., the ampicillin resistance gene of *E. coli,* the *S. cerevisiae* TRP1 gene, etc.; and a promoter derived from a highly-expressed gene to direct transcription of the coding sequence. Such promoters can be derived from operons encoding glycolytic enzymes such as 3-phosphoglycerate kinase (PGK), α-factor, acid phosphatase, or heat shock proteins, among others.

Inducible promoters are well known in the art. Suitable inducible promoters may include, but are not limited to, the pL of bacteriophage λ; Plac; Ptrp; Ptac (Ptrp-lac hybrid promoter); an isopropyl-beta-D-thiogalactopyranoside (IPTG)-inducible promoter, e.g., a lacZ promoter; a tetracycline-inducible promoter; an arabinose inducible promoter, e.g., $P_{BAD}$ (see, e.g., Guzman et al. (1995) *J. Bacteriol.* 177:4121-4130); a xylose-inducible promoter, e.g., Pxyl (see, e.g., Kim et al. (1996) *Gene* 181:71-76); a GAL1 promoter; a tryptophan promoter; a lac promoter; an alcohol-inducible promoter, e.g., a methanol-inducible promoter, an ethanol-inducible promoter; a raffinose-inducible promoter; a heat-inducible promoter, e.g., heat inducible lambda $P_L$ promoter, a promoter controlled by a heat-sensitive repressor (e.g., CI857-repressed lambda-based expression vectors; see, e.g., Hoffmann et al. (1999) *FEMS Microbiol Lett.* 177(2):327-34); and the like.

In addition, the expression vectors or constructs will in many embodiments contain one or more selectable marker genes to provide a phenotypic trait for selection of transformed host cells such as dihydrofolate reductase or neomycin resistance for eukaryotic cell culture, or such as tetracycline or ampicillin resistance in prokaryotic host cells such as *E. coli*.

In some embodiments, one or more heterologous nucleic acids disclosed herein is integrated into the genome of the genetically modified host cell disclosed herein. In some embodiments, one or more heterologous nucleic acids disclosed herein remains episomal (i.e., is not integrated into the genome of the genetically modified host cell). In some embodiments, at least one of the one or more heterologous nucleic acids disclosed herein is maintained extrachromosomally.

In some embodiments, a subject heterologous nucleic acid or a subject recombinant expression vector or construct comprises a promoter or other regulatory element(s) for expression in a plant cell. Non-limiting examples of suitable constitutive promoters that are functional in a plant cell is the cauliflower mosaic virus 35S promoter, a tandem 35S promoter (Kay et al., *Science* 236:1299 (1987)), a cauliflower mosaic virus 19S promoter, a nopaline synthase gene promoter (Singer et al., *Plant Mol. Biol.* 14:433 (1990); An, *Plant Physiol.* 81:86 (1986), an octopine synthase gene promoter, and a ubiquitin promoter. Suitable inducible promoters that are functional in a plant cell may include, but are not limited to, a phenylalanine ammonia-lyase gene promoter, a chalcone synthase gene promoter, a pathogenesis-related protein gene promoter, a copper-inducible regulatory element Nett et al., *Proc. Natl. Acad. Sci. USA* 90:4567-4571 (1993); Furst et al., *Cell* 55:705-717 (1988)); tetracycline and chlor-tetracycline-inducible regulatory elements (Gatz et al., *Plant J.* 2:397-404 (1992); Röder et al., *Mol. Gen. Genet.* 243:32-38 (1994); Gatz, *Meth. Cell Biol.* 50:411-424 (1995)); ecdysone inducible regulatory elements (Christopherson et al., *Proc. Natl. Acad. Sci. USA* 89:6314-6318 (1992); Kreutzweiser et al., *Ecotoxicol. Environ. Safely* 28:14-24 (1994)); heat shock inducible regulatory elements (Takahashi et al., *Plant Physiol.* 99:383-390 (1992); Yabe et al., *Plant Cell Physiol.* 35:1207-1219 (1994); Ueda et al., *Mol. Gen. Genet.* 250:533-539 (1996)); and lac operon elements, which are used in combination with a constitutively expressed lac repressor to confer, for example, IPTG-inducible expression (Wilde et al., *EMBO.* 11:1251-1259 (1992); a nitrate-inducible promoter derived from the spinach nitrite reductase gene (Back et al., *Plant Mol. Biol.* 17:9 (1991)); a light-inducible promoter, such as that associated with the small subunit of RuBP carboxylase or the LHCP gene families (Feinbaum et al., *Mol. Gen. Genet.* 226:449 (1991); Lam and Chua, *Science* 248:471 (1990)); a light-responsive regulatory element as described in U.S. Patent Publication No. 20040038400; a salicylic acid inducible regulatory elements (Uknes et al., *Plant Cell* 5:159-169 (1993); Bi et al., *Plant J.* 8:235-245 (1995)); plant hormone-inducible regulatory elements (Yamaguchi-Shinozaki et al., *Plant Mol. Biol.* 15:905 (1990); Kares et al., *Plant Mol. Biol.* 15:225 (1990)); and human hormone-inducible regulatory elements such as the human glucocorticoid response element (Schena et al., *Proc. Natl. Acad. Sci. USA* 88:10421 (1991).

Plant tissue-selective regulatory elements also can be included in a subject heterologous nucleic acid or a subject vector or construct. Suitable tissue-selective regulatory elements, which can be used to ectopically express a heterologous nucleic acid in a single tissue or in a limited number of tissues, may include, but are not limited to, a xylem-selective regulatory element, a tracheid-selective regulatory element, a fiber-selective regulatory element, a trichome-selective regulatory element (see, e.g., Wang et al. (2002) *J. Exp. Botany* 53:1891-1897), a glandular trichome-selective regulatory element, and the like.

Vectors that are suitable for use in plant cells are known in the art, and any such vector can be used to introduce a subject heterologous nucleic acid into a plant host cell. Suitable vectors may include, e.g., a Ti plasmid of *Agrobacterium tumefaciens* or an $Ri_1$ plasmid of *A. rhizogenes*. The Ti or $Ri_1$ plasmid is transmitted to plant cells on infection by *Agrobacterium* and is stably integrated into the plant genome. J. Schell, *Science*, 237:1176-83 (1987). Also suitable for use is a plant artificial chromosome, as described in, e.g., U.S. Pat. No. 6,900,012.

As will be appreciated by the skilled artisan, slight changes in nucleotide sequence do not necessarily alter the amino acid sequence of the encoded polypeptide. It will be appreciated by persons skilled in the art that changes in the identities of nucleotides in a specific gene sequence that change the amino acid sequence of the encoded polypeptide may result in reduced or enhanced effectiveness of the genes and that, in some applications (e.g., anti-sense, co-suppression, or RNAi), partial sequences often work as effectively as full length versions. The ways in which the nucleotide sequence can be varied or shortened are well known to persons skilled in the art, as are ways of testing the effectiveness of the altered genes. In certain embodiments, effectiveness may easily be tested by, for example, conventional gas chromatography. All such variations of the genes are therefore included as part of the present disclosure.

Codon Usage

As is well known to those of skill in the art, it is possible to improve the expression of a heterologous nucleic acid in a host organism by replacing the nucleotide sequences coding for a particular amino acid (i.e., a codon) with another codon which is better expressed in the host organism (i.e., codon optimization). One reason that this effect arises due to the fact that different organisms show preferences for different codons. In some embodiments, a heterologous nucleic acid disclosed herein is modified or optimized such that the nucleotide sequence reflects the codon preference for the particular host cell. For example, the nucleotide sequence will in some embodiments be modified or optimized for yeast codon preference. See, e.g., Bennetzen and Hall (1982) *J. Biol. Chem.* 257(6): 3026-3031. As another non-limiting example, the nucleotide sequence will in some embodiments be modified or optimized for *E. coli* codon preference. See, e.g., Gouy and Gautier (1982) *Nucleic Acids Res.* 10(22):7055-7074; Eyre-Walker (1996) *Mol. Biol. Evol.* 13(6):864-872. See also Nakamura et al. (2000) *Nucleic Acids Res.* 28(1):292.

Statistical methods have been generated to analyze codon usage bias in various organisms and many computer algorithms have been developed to implement these statistical analyses in the design of codon optimized gene sequences (Lithwick G, Margalit H (2003) Hierarchy of sequence-dependent features associated with prokaryotic translation. Genome Research 13: 2665-73). Other modifications in codon usage to increase protein expression that are not dependent on codon bias have also been described (Welch et al. (2009). Design parameters to control synthetic gene expression in *Escherichia coli*. PLoS ONE 4: e7002).

In some embodiments, the codon usage of a coding sequence is modified such that the level of translation of the encoded mRNA is decreased. Reducing the level of translation of an mRNA by modifying codon usage is achieved by modifying the sequence to include codons that are rare or not commonly used by the host cell. Codon usage tables for many organisms are available that summarize the percentage of time a specific organism uses a specific codon to encode for an amino acid. Certain codons are used more often than other, "rare" codons. The use of "rare" codons in a sequence generally decreases its rate of translation. Thus, e.g., the coding sequence is modified by introducing one or more rare codons, which affect the rate of translation, but not the amino acid sequence of the polypeptide translated. For example, there are 6 codons that encode for arginine: CGT, CGC, CGA, CGG, AGA, and AGG. In *E. coli* the codons CGT and CGC are used far more often (encoding approximately 40% of the arginines in *E. coli* each) than the codon AGG (encoding approximately 2% of the arginines in *E. coli*). Modifying a CGT codon within the sequence of a gene to an AGG codon would not change the sequence of the polypeptide, but would likely decrease the gene's rate of translation.

Further, it will be appreciated that this disclosure embraces the degeneracy of codon usage as would be understood by one of ordinary skill in the art and illustrated in the following table.

Codon Degeneracies

| Amino Acid | Codons |
|---|---|
| Ala/A | GCT, GCC, GCA, GCG |
| Arg/R | CGT, CGC, CGA, CGG, AGA, AGG |
| Asn/N | AAT, AAC |
| Asp/D | GAT, GAC |
| Cys/C | TGT, TGC |
| Gln/Q | CAA, CAG |
| Glu/E | GAA, GAG |
| Gly/G | GGT, GGC, GGA, GGG |
| His/H | CAT, CAC |
| Ile/I | ATT, ATC, ATA |
| Leu/L | TTA, TTG, CTT, CTC, CTA, CTG |
| Lys/K | AAA, AAG |
| Met/M | ATG |
| Phe/F | TTT, TTC |
| Pro/P | CCT, CCC, CCA, CCG |
| Ser/S | TCT, TCC, TCA, TCG, AGT, AGC |
| Thr/T | ACT, ACC, ACA, ACG |
| Trp/W | TGG |
| Tyr/Y | TAT, TAC |
| Val/V | GTT, GTC, GTA, GTG |
| START | ATG |
| STOP | TAG, TGA, TAA |

Genetically Modified Plants

The present disclosure provides genetically modified plants, where the genetically modified plants are genetically modified with one or more heterologous nucleic acids disclosed herein to generate a cannabinoid, a cannabinoid derivative, a cannabinoid precursor, or a cannabinoid precursor derivative. In some embodiments, the genetically modified plant is a plant of a genus other than *Cannabis*.

The present disclosure provides a genetically modified plant, wherein the genetically modified plant is genetically modified with: a) one or more heterologous nucleic acids that encode a polypeptide that generates an acyl-CoA compound or an acyl-CoA compound derivative; b) one or more heterologous nucleic acids that encode a polypeptide that generates GPP; c) one or more heterologous nucleic acids that encode a polypeptide that generates malonyl-CoA; d) one or more heterologous nucleic acids that encode one or more polypeptides that condense an acyl-CoA compound or an acyl-CoA compound derivative and malonyl-CoA to generate olivetolic acid or derivatives of olivetolic acid; e) one or more heterologous nucleic acids that encode a polypeptide that condenses GPP and olivetolic acid to generate cannabigerolic acid or derivatives thereof; or f) one or more heterologous nucleic acids that encode a cannabinoid synthase polypeptide, wherein the polypeptides are produced in the plant, and wherein production of the polypeptides results in production of a cannabinoid, a cannabinoid derivative, a cannabinoid precursor, or a cannabinoid precursor derivative by the genetically modified plant. In some embodiments, the plant is a monocot. In some embodiments, the plant is a dicot. In some embodiments, one or more of the polypeptide-encoding heterologous nucleic acids is operably linked to a constitutive promoter. In some embodiments, one or more of the polypeptide-encoding heterologous nucleic acids is operably linked to an inducible promoter. In some embodiments, one or more of the polypeptide-encoding heterologous nucleic acids is operably linked to a tissue-specific promoter. In some embodiments, the tissue-specific promoter is a trichome-specific promoter.

The present disclosure provides a method of producing a cannabinoid, a cannabinoid derivative, a cannabinoid precursor, or a cannabinoid precursor derivative, the method comprising maintaining a transgenic plant under conditions that favor production of the encoded one or more polypeptides, wherein production of the encoded one or more polypeptides results in production of the cannabinoid, the cannabinoid derivative, the cannabinoid precursor, or the cannabinoid precursor derivative.

In some embodiments, the genome of the transgenic plant comprises a subject heterologous nucleic acid. In some embodiments, the transgenic plant is homozygous for the genetic modification. In some embodiments, the transgenic plant is heterozygous for the genetic modification.

In some embodiments, a subject transgenic plant produces one or more transgene-encoded polypeptides disclosed herein that result in the production of a cannabinoid, a cannabinoid derivative, a cannabinoid precursor, or a cannabinoid precursor derivative in an amount that is at least about 50%, at least about 2-fold, at least about 5-fold, at least about 10-fold, at least about 25-fold, at least about 50-fold, or at least about 100-fold, or higher, than the amount of the cannabinoid, a cannabinoid derivative, a cannabinoid precursor, or a cannabinoid precursor derivative produced by a control plant, e.g., a non-transgenic plant (a plant that does not include the transgene encoding the one or more polypeptides) of the same species.

In some embodiments, a subject transgenic plant is a transgenic version of a control, non-transgenic plant that normally produces a cannabinoid, a cannabinoid derivative, a cannabinoid precursor, or a cannabinoid precursor derivative that is generated by, or is a downstream product of, transgene-encoded one or more polypeptides that produce a cannabinoid, a cannabinoid derivative, a cannabinoid precursor, or a cannabinoid precursor derivative; where the transgenic plant produces the cannabinoid, a cannabinoid derivative, a cannabinoid precursor, or a cannabinoid precursor derivative in an amount that is at least about 50%, at least about 2-fold, at least about 5-fold, at least about 10-fold, at least about 25-fold, at least about 50-fold, or at least about 100-fold, or higher, than the amount of the cannabinoid, a cannabinoid derivative, a cannabinoid precursor, or a cannabinoid precursor derivative produced by the control plant, e.g., a non-transgenic plant (a plant that does not include the transgene encoding the one or more polypeptides) of the same species.

Methods of introducing exogenous nucleic acids into plant cells are well known in the art. Such plant cells are considered "transformed." Suitable methods may include viral infection (such as double stranded DNA viruses), transfection, conjugation, protoplast fusion, electroporation, particle gun technology, calcium phosphate precipitation, direct microinjection, silicon carbide whiskers technology, *Agrobacterium*-mediated transformation, CRISPR/Cas9-mediated genome editing, and the like. The choice of method is generally dependent on the type of cell being transformed and the circumstances under which the transformation is taking place (e.g., in vitro, ex vivo, or in vivo).

A CRISPR/Cas9 system can be used to generate a transgenic (genetically modified) plant of the present disclosure. CRISPR/Cas9 systems and methods are known in the art. See, e.g., Bortesi and Fischer (2015) *Biotechnol. Advances* 33:41; and Fan et al. (2015) *Sci. Reports* 5:12217.

Transformation methods based upon the soil bacterium *Agrobacterium tumefaciens* can be used for introducing an exogenous nucleic acid into a vascular plant. The wild type form of *Agrobacterium* contains a Ti (tumor-inducing) plasmid that directs production of tumorigenic crown gall growth on host plants. Transfer of the tumor-inducing T-DNA region of the Ti plasmid to a plant genome requires the Ti plasmid-encoded virulence genes as well as T-DNA borders, which are a set of direct DNA repeats that delineate the region to be transferred. An *Agrobacterium*-based vector is a modified form of a Ti plasmid, in which the tumor inducing functions are replaced by the nucleotide sequence of interest to be introduced into the plant host.

*Agrobacterium*-mediated transformation generally employs cointegrate vectors or, e.g., binary vector systems, in which the components of the Ti plasmid are divided between a helper vector, which resides permanently in the *Agrobacterium* host and carries the virulence genes, and a shuttle vector, which contains the gene of interest bounded by T-DNA sequences. A variety of binary vectors are well known in the art and are commercially available, for example, from Clontech (Palo Alto, Calif.). Methods of coculturing *Agrobacterium* with cultured plant cells or wounded tissue such as leaf tissue, root explants, hypocotyledons, stem pieces or tubers, for example, also are well known in the art. See, e.g., Glick and Thompson, (eds.), *Methods in Plant Molecular Biology and Biotechnology*, Boca Raton, Fla.: CRC Press (1993).

*Agrobacterium*-mediated transformation is useful for producing a variety of transgenic vascular plants (Wang et al., supra, 1995) including at least one species of *Eucalyptus* and forage legumes such as alfalfa (lucerne); birdsfoot trefoil, white clover, *Stylosanthes, Lotononis bainessii* and sainfoin.

Microprojectile-mediated transformation also can be used to produce a subject transgenic plant. This method, first described by Klein et al. (*Nature* 327:70-73 (1987)), relies on microprojectiles such as gold or tungsten that are coated with the desired heterologous nucleic acid by precipitation with calcium chloride, spermidine or polyethylene glycol. The microprojectile particles are accelerated at high speed into an angiosperm tissue using a device such as the BIOLISTIC PD-1000 (Biorad; Hercules Calif.).

A subject heterologous nucleic acid may be introduced into a plant in a manner such that the heterologous nucleic acid is able to enter a plant cell(s), e.g., via an in vivo or ex vivo protocol. By "in vivo," it may mean that the heterologous nucleic acid is administered to a living body of a plant e.g. infiltration. By "ex vivo" it may mean that cells or explants are modified outside of the plant, and then such cells or organs are regenerated to a plant. A number of vectors or constructs suitable for stable transformation of plant cells or for the establishment of transgenic plants have been described, including those described in Weissbach and Weissbach, (1989) Methods for Plant Molecular Biology Academic Press, and Gelvin et al., (1990) Plant Molecular Biology Manual, Kluwer Academic Publishers. Specific examples may include those derived from a Ti plasmid of *Agrobacterium tumefaciens*, as well as those disclosed by Herrera-Estrella et al. (1983) Nature 303: 209, Bevan (1984) Nucl Acid. Res. 12: 8711-8721, Klee (1985) Bio/Technolo 3: 637-642. Alternatively, non-Ti vectors can be used to transfer the DNA into plants and cells by using free DNA delivery techniques. By using these methods transgenic plants such as wheat, rice (Christou (1991) Bio/Technology 9:957-962) and corn (Gordon-Kamm (1990) Plant Cell 2: 603-618) can be produced. An immature embryo can also be a good target tissue for monocots for direct DNA delivery techniques by using the particle gun (Weeks et al. (1993) Plant Physiol 102: 1077-1084; Vasil (1993) Bio/Technolo 10: 667-674; Wan and Lemeaux (1994) Plant Physiol 104: 37-48 and for *Agrobacterium*-mediated DNA transfer (Ishida et al. (1996) Nature Biotech 14: 745-750). Exemplary methods for introduction of DNA into chloroplasts are biolistic bombardment, polyethylene glycol transformation of protoplasts, and microinjection (Danieli et al Nat. Biotechnol 16:345-348, 1998; Staub et al Nat. Biotechnol 18: 333-338, 2000; O'Neill et al Plant J. 3:729-738, 1993; Knoblauch et al Nat. Biotechnol 17: 906-909; U.S. Pat. Nos. 5,451,513, 5,545,817, 5,545,818, and 5,576,198; in Intl. Application No. WO 95/16783; and in Boynton et al., Methods in Enzymology 217: 510-536 (1993), Svab et al., Proc. Natl. Acad. Sci. USA 90: 913-917 (1993), and McBride et al., Proc. Natl. Acad. Sci. USA 91: 7301-7305 (1994)). Any vector suitable for the methods of biolistic bombardment, polyethylene glycol transformation of protoplasts and microinjection will be suitable as a targeting vector for chloroplast transformation. Any double stranded DNA vector may be used as a transformation vector, especially when the method of introduction does not utilize *Agrobacterium*.

Plants which can be genetically modified may include grains, forage crops, fruits, vegetables, oil seed crops, palms, forestry, and vines. Specific examples of plants which can be modified may include, but are not limited to, maize, banana, peanut, field peas, sunflower, tobacco, tomato, canola, tobacco, wheat, barley, oats, potato, soybeans, cotton, sorghum, lupin, and rice. Plants which can be genetically modified may include *Theobroma cacao*.

Also provided by the present disclosure are transformed plant cells, tissues, plants and products that contain the transformed plant cells. A feature of the subject transformed cells, and tissues and products that include the same is the presence of a subject heterologous nucleic acid integrated into the genome, and production by plant cells of one or more polypeptides that are utilized to generate a cannabinoid, a cannabinoid derivative, a cannabinoid precursor, or a cannabinoid precursor derivative. Recombinant plant cells of the present disclosure are useful as populations of recombinant cells, or as a tissue, seed, whole plant, stem, fruit, leaf, root, flower, stem, tuber, grain, animal feed, a field of plants, and the like.

Also provided by the present disclosure is reproductive material of a subject transgenic plant, where reproductive material may include seeds, progeny plants and clonal material, where such material can give rise to a plant that produces a cannabinoid, a cannabinoid derivative, a cannabinoid precursor, or a cannabinoid precursor derivative.

Methods of Producing a Cannabinoid, a Cannabinoid Precursor, a Cannabinoid Derivative, or a Cannabinoid Precursor Derivative The present disclosure provides methods of producing a cannabinoid, a cannabinoid derivative, a cannabinoid precursor, or a cannabinoid precursor derivative. The methods may involve culturing a genetically modified host cell of the present disclosure in a suitable medium and recovering the produced cannabinoid, the cannabinoid precursor, the cannabinoid precursor derivative, or the cannabinoid derivative. The methods may also involve cell-free production of cannabinoids, cannabinoid precursors, cannabinoid precursor derivatives, or cannabinoid derivatives using one or more polypeptides disclosed herein expressed or overexpressed by a genetically modified host cell of the disclosure.

The present disclosure provides methods of producing a cannabinoid or a cannabinoid derivative. The methods may involve culturing a genetically modified host cell of the present disclosure in a suitable medium and recovering the produced cannabinoid or cannabinoid derivative. The methods may also involve cell-free production of cannabinoids or cannabinoid derivatives using one or more polypeptides disclosed herein expressed or overexpressed by a genetically modified host cell of the disclosure.

Cannabinoids, cannabinoid derivatives, cannabinoid precursors, or cannabinoid precursor derivatives that can be produced with the methods or genetically modified host cells of the present disclosure may include, but are not limited to, cannabichromene (CBC) type (e.g. cannabichromenic acid), cannabigerol (CBG) type (e.g. cannabigerolic acid), cannabidiol (CBD) type (e.g. cannabidiolic acid), $\Delta^9$-trans-tetrahydrocannabinol ($\Delta^9$-THC) type (e.g. $\Delta^9$-tetrahydrocannabinolic acid), $\Delta^8$-trans-tetrahydrocannabinol ($\Delta^8$-THC) type, cannabicyclol (CBL) type, cannabielsoin (CBE) type, cannabinol (CBN) type, cannabinodiol (CBND) type, cannabitriol (CBT) type, olivetolic acid, GPP, derivatives of any of the foregoing, and others as listed in Elsohly M. A. and Slade D., Life Sci. 2005 Dec. 22; 78(5):539-48. Epub 2005 Sep. 30.

Cannabinoids or cannabinoid derivatives that can be produced with the methods or genetically modified host cells of the present disclosure may also include, but are not limited to, cannabigerolic acid (CBGA), cannabigerolic acid monomethylether (CBGAM), cannabigerol (CBG), cannabigerol monomethylether (CBGM), cannabigerovarinic acid (CBGVA), cannabigerovarin (CBGV), cannabichromenic acid (CBCA), cannabichromene (CBC), cannabichromevarinic acid (CBCVA), cannabichromevarin (CBCV), cannabidiolic acid (CBDA), cannabidiol (CBD), cannabidiol monomethylether (CBDM), cannabidiol-$C_4$ (CBD-$C_4$), cannabidivarinic acid (CBDVA), cannabidivarin (CBDV), cannabidiorcol (CBD-$C_1$), $\Delta^9$-tetrahydrocannabinolic acid A (THCA-A), $\Delta^9$-tetrahydrocannabinolic acid B (THCA-B), $\Delta^9$-tetrahydrocannabinol (THC), $\Delta^9$-tetrahydrocannabinolic acid-$C_4$ (THCA-$C_4$), $\Delta^9$-tetrahydrocannabinol-$C_4$ (THC-$C_4$), $\Delta^9$-tetrahydrocannabivarinic acid (THCVA), $\Delta^9$-tetrahydrocannabivarin (THCV), $\Delta^9$-tetrahydrocannabiorcolic acid (THCA-$C_1$), $\Delta^9$-tetrahydrocannabiorcol (THC-$C_1$), $\Delta^7$-cis-iso-tetrahydrocannabivarin, $\Delta^8$-tetrahydrocannabinolic acid ($\Delta^8$-THCA), $\Delta^8$-tetrahydrocannabinol ($\Delta^8$-THC), cannabicyclolic acid (CBLA), cannabicyclol (CBL), cannabicyclovarin (CBLV), cannabielsoic acid A (CBEA-A), cannabielsoic acid B (CBEA-B), cannabielsoin (CBE), cannabielsoinic acid, cannabicitranic acid, cannabinolic acid (CBNA), cannabinol (CBN), cannabinol methylether (CBNM), cannabinol-$C_4$, (CBN-$C_4$), cannabivarin (CBV), cannabinol-$C_2$ (CNB-$C_2$), cannabiorcol (CBN-$C_1$), cannabinodiol (CBND), cannabinodivarin (CBVD), cannabitriol (CBT), 10-ethyoxy-9-hydroxy-delta-6a-tetrahydrocannabinol, 8,9-dihydroxyl-delta-6a-tetrahydrocannabinol, cannabitriolvarin (CBTVE), dehydrocannabifuran (DCBF), cannabifuran (CBF), cannabichromanon (CBCN), cannabicitran (CBT), 10-oxo-delta-6a-tetrahydrocannabinol (OTHC), delta-9-cis-tetrahydrocannabinol (cis-THC), 3,4,5, 6-tetrahydro-7-hydroxy-alpha-alpha-2-trimethyl-9-n-propyl-2,6-methano-2H-1-benzoxocin-5-methanol (OH-iso-HHCV), cannabiripsol (CBR), trihydroxy-delta-9-tetrahydrocannabinol (triOH-THC), and derivatives of any of the foregoing.

Additional cannabinoid derivatives that can be produced with the methods or genetically modified host cells of the present disclosure may also include, but are not limited to, 2-geranyl-5-pentyl-resorcylic acid, 2-geranyl-5-(4-pentynyl)-resorcylic acid, 2-geranyl-5-(trans-2-pentenyl)-resorcylic acid, 2-geranyl-5-(4-methylhexyl)-resorcylic acid, 2-geranyl-5-(5-hexynyl) resorcylic acid, 2-geranyl-5-(trans-2-hexenyl)-resorcylic acid, 2-geranyl-5-(5-hexenyl)-resorcylic acid, 2-geranyl-5-heptyl-resorcylic acid, 2-geranyl-5-(6-heptynoic)-resorcylic acid, 2-geranyl-5-octyl-resorcylic acid, 2-geranyl-5-(trans-2-octenyl)-resorcylic acid, 2-geranyl-5-nonyl-resorcylic acid, 2-geranyl-5-(trans-2-nonenyl) resorcylic acid, 2-geranyl-5-decyl-resorcylic acid, 2-geranyl-5-(4-phenylbutyl)-resorcylic acid, 2-geranyl-5-(5-phenylpentyl)-resorcylic acid, 2-geranyl-5-(6-phenylhexyl)-resorcylic acid, 2-geranyl-5-(7-phenylheptyl)-resorcylic acid, (6aR,10aR)-1-hydroxy-6,6,9-trimethyl-3-propyl-6a,7,8, 10a-tetrahydro-6H-dibenzo[b,d]pyran-2-carboxylic acid, (6aR,10aR)-1-hydroxy-6,6,9-trimethyl-3-(4-methylhexyl)-6a,7,8,10a-tetrahydro-6H-dibenzo[b,d]pyran-2-carboxylic acid, (6aR,10aR)-1-hydroxy-6,6,9-trimethyl-3-(5-hexenyl)-6a,7,8,10a-tetrahydro-6H-dibenzo[b,d]pyran-2-carboxylic acid, (6aR,10aR)-1-hydroxy-6,6,9-trimethyl-3-(5-hexenyl)-6a,7,8,10a-tetrahydro-6H-dibenzo[b,d]pyran-2-carboxylic acid, (6aR,10aR)-1-hydroxy-6,6,9-trimethyl-3-(6-heptynyl)-6a,7,8,10a-tetrahydro-6H-dibenzo[b,d]pyran-2-carboxylic acid, 3-[(2E)-3,7-dimethylocta-2,6-dien-1-yl]-6-(hexan-2-yl)-2,4-dihydroxybenzoic acid, 3-[(2E)-3,7-dimethylocta-2,6-dien-1-yl]-2,4-dihydroxy-6-(2-methylpentyl)benzoic acid, 3-[(2E)-3,7-dimethylocta-2,6-dien-1-yl]-2,4-dihydroxy-6-(3-methylpentyl)benzoic acid, 3-[(2E)-3,7-dimethylocta-2,6-dien-1-yl]-2,4-dihydroxy-6-(4-methylpentyl)benzoic acid, 3-[(2E)-3,7-dimethylocta-2, 6-dien-1-yl]-2,4-dihydroxy-6-[(2E)-pent-1-en-1-yl]benzoic acid, 3-[(2E)-3,7-dimethylocta-2,6-dien-1-yl]-2,4-dihydroxy-6-[(2E)-pent-2-en-1-yl]benzoic acid, 3-[(2E)-3,7-dimethylocta-2,6-dien-1-yl]-2,4-dihydroxy-6-[(2E)-pent-3-en-1-yl]benzoic acid, 3-[(2E)-3,7-dimethylocta-2,6-dien-1-yl]-2,4-dihydroxy-6-(pent-4-en-1-yl)benzoic acid, 3-[(2E)-3,7-dimethylocta-2,6-dien-1-yl]-2,4-dihydroxy-6-propylbenzoic acid, 3-[(2E)-3,7-dimethylocta-2,6-dien-1-yl]-2,4-dihydroxy-6-butylbenzoic acid, 3-[(2E)-3,7-dimethylocta-2,6-dien-1-yl]-2,4-dihydroxy-6-hexylbenzoic acid, 3-[(2E)-3,7-dimethylocta-2,6-dien-1-yl]-2,4-dihydroxy-6-heptylbenzoic acid, 3-[(2E)-3,7-dimethylocta-2,6-dien-1-yl]-2,4-dihydroxy-6-octylbenzoic acid, 3-[(2E)-3,7-dimethylocta-2,6-dien-1-yl]-2,4-dihydroxy-6-nonanylbenzoic acid, 3-[(2E)-3,7-dimethylocta-2,6-dien-1-yl]-2,4-dihydroxy-6-decanylbenzoic acid, 3-[(2E)-3,7-dimethylocta-2,6-dien-1-yl]-2,4-dihydroxy-6-undecanylbenzoic acid, 6-(4-chlorobutyl)-3-[(2E)-3,7-dimethylocta-2,6-dien-1-yl]-2,4-dihydroxybenzoic acid, 3-[(2E)-3,7-dimethylocta-2,6-dien-1-yl]-2,4-dihydroxy-6-[4-(methylsulfanyl)butyl]benzoic acid, and others as listed in Bow, E. W. and Rimoldi, J. M., "The Structure—Function Relationships of Classical Cannabinoids: CB1/CB2 Modulation," *Perspectives in Medicinal Chemistry* 2016:8 17-39 doi: 10.4137/PMC.S32171, incorporated by reference herein.

Cannabinoid precursor derivatives that can be produced with the methods or genetically modified host cells of the present disclosure may also include, but are not limited to, divarinolic acid, 5-pentyl-resorcylic acid, 5-(4-pentynyl)-resorcylic acid, 5-(trans-2-pentenyl)-resorcylic acid, 5-(4-methylhexyl)-resorcylic acid, 5-(5-hexynyl)-resorcylic acid, 5-(trans-2-hexenyl)-resorcylic acid, 5-(5-hexenyl)-resorcylic acid, 5-heptyl-resorcylic acid, 5-(6-heptynoic)-resorcylic acid, 5-octyl-resorcylic acid, 5-(trans-2-octenyl)-resorcylic acid, 5-nonyl-resorcylic acid, 5-(trans-2-nonenyl)-resorcylic acid, 5-decyl-resorcylic acid, 5-(4-phenylbutyl)-resorcylic acid, 5-(5-phenylpentyl)-resorcylic acid, 5-(6-phenylhexyl)-resorcylic acid, and 5-(7-phenylheptyl)-resorcylic acid.

Cannabinoids, cannabinoid derivatives, cannabinoid precursors, or cannabinoid precursor derivatives that can be produced with the methods or genetically modified host cells of the present disclosure may also include, but are not limited to, polyketides or polyketide derivatives.

A cannabinoid derivative or cannabinoid precursor derivative may lack one or more chemical moieties found in a naturally-occurring cannabinoid or naturally-occurring cannabinoid precursor. Such chemical moieties may include, but are not limited to, methyl, alkyl, alkenyl, methoxy, alkoxy, acetyl, carboxyl, carbonyl, oxo, ester, hydroxyl, aryl, heteroaryl, cycloalkyl, cycloalkenyl, cycloalkylalkenyl, cycloalkenylalkyl, cycloalkenylalkenyl, heterocyclylalkenyl, heteroarylalkenyl, arylalkenyl, heterocyclyl, aralkyl, cycloalkylalkyl, heterocyclylalkyl, heteroarylalkyl, and the like. In some embodiments, a cannabinoid derivative or cannabinoid precursor derivative lacking one or more chemical moieties found in a naturally-occurring cannabinoid or naturally-occurring cannabinoid precursor, and produced by a genetically modified host cell disclosed herein or in a cell-free reaction mixture comprising one or more of the polypeptides disclosed herein, may also comprise one or more of any of the functional and/or reactive groups described herein. Functional and reactive groups may be optionally substituted with one or more additional functional or reactive groups.

A cannabinoid derivative or cannabinoid precursor derivative may be a cannabinoid or cannabinoid precursor comprising one or more functional and/or reactive groups and is produced by a genetically modified host cell disclosed herein or in a cell-free reaction mixture comprising one or more of the polypeptides disclosed herein. Functional groups may include, but are not limited to, azido, halo (e.g., chloride, bromide, iodide, fluorine), methyl, alkyl, alkynyl, alkenyl, methoxy, alkoxy, acetyl, amino, carboxyl, carbonyl, oxo, ester, hydroxyl, thio, cyano, aryl, heteroaryl, cycloalkyl, cycloalkenyl, cycloalkylalkenyl, cycloalkylalkynyl, cycloalkenylalkyl, cycloalkenylalkenyl, cycloalkenylalkynyl, heterocyclylalkenyl, heterocyclylalkynyl, heteroarylalkenyl, heteroarylalkynyl, arylalkenyl, arylalkynyl, spirocyclyl, heterospirocyclyl, heterocyclyl, thioalkyl, sulfone, sulfonyl, sulfoxide, amino, alkylamino, dialkylamino, arylamino, alkylarylamino, diarylamino, N-oxide, imide, enamine, imine, oxime, hydrazone, nitrile, aralkyl, cycloalkylalkyl, haloalkyl, heterocyclylalkyl, heteroarylalkyl, nitro, thioxo, and the like. See, e.g., FIGS. 12 and 13. Suitable reactive groups may include, but are not necessarily limited to, azide, carboxyl, carbonyl, amine, (e.g., alkyl amine (e.g., lower alkyl amine), aryl amine), halide, ester (e.g., alkyl ester (e.g., lower alkyl ester, benzyl ester), aryl ester, substituted aryl ester), cyano, thioester, thioether, sulfonyl halide, alcohol, thiol, succinimidyl ester, isothiocyanate, iodoacetamide, maleimide, hydrazine, alkynyl, alkenyl, acetyl, and the like. In some embodiments, the reactive group is selected from a carboxyl, a carbonyl, an amine, an ester, a thioester, a thioether, a sulfonyl halide, an alcohol, a thiol, an alkyne, alkene, an azide, a succinimidyl ester, an isothiocyanate, an iodoacetamide, a maleimide, and a hydrazine. Functional and reactive groups may be optionally substituted with one or more additional functional or reactive groups.

A reactive group may facilitate covalent attachment of a molecule of interest. Suitable molecules of interest may include, but are not limited to, a detectable label; imaging agents; a toxin (including cytotoxins); a linker; a peptide; a drug (e.g., small molecule drugs); a member of a specific binding pair; an epitope tag; ligands for binding by a target receptor; tags to aid in purification; molecules that increase solubility; and the like. A linker may be a peptide linker or a non-peptide linker.

In some embodiments, a cannabinoid derivative or a cannabinoid precursor derivative comprising an azide may be reacted with a compound comprising an alkyne group via "click chemistry" to generate a product comprising a heterocycle, also known as an azide-alkyne cycloaddition. In some embodiments, a cannabinoid derivative or a cannabinoid precursor derivative comprising an alkyne may be reacted with a compound comprising an azide group via click chemistry to generate a product comprising a heterocycle.

Additional molecules that may be desirable for attachment to a cannabinoid derivative or cannabinoid precursor derivative may include, but are not necessarily limited to, detectable labels (e.g., spin labels, fluorescence resonance energy transfer (FRET)-type dyes, e.g., for studying structure of biomolecules in vivo); small molecule drugs; cytotoxic molecules (e.g., drugs); imaging agents; ligands for binding by a target receptor; tags to aid in purification by, for example, affinity chromatography (e.g., attachment of a FLAG epitope); molecules that increase solubility (e.g., poly(ethylene glycol); molecules that enhance bioavailability; molecules that increase in viva half-life; molecules that target to a particular cell type (e.g., an antibody specific for an epitope on a target cell); molecules that target to a particular tissue; molecules that provide for crossing the blood-brain barrier; and molecules to facilitate selective attachment to a surface, and the like.

In some embodiments, a molecule of interest comprises an imaging agent. Suitable imaging agents may include positive contrast agents and negative contrast agents. Suitable positive contrast agents may include, but are not limited to, gadolinium tetraazacyclododecanetetraacetic acid (Gd-DOTA); gadolinium-diethylenetriaminepentaacetic acid (Gd-DTPA); gadolinium-1,4,7-tris(carbonylmethyl)-10-(2'-hydroxypropyl)-1,4,7,10-tetraazacyclododecane (Gd-HP-DO3A); Manganese(II)-dipyridoxal diphosphate (Mn-DPDP); Gd-diethylenetriaminepentaacetate-bis (methylamide) (Gd-DTPA-BMA); and the like. Suitable negative contrast agents may include, but are not limited to, a superparamagnetic iron oxide (SPIO) imaging agent; and a perfluorocarbon, where suitable perfluorocarbons may include, but are not limited to, fluoroheptanes, fluorocycloheptanes, fluoromethylcycloheptanes, fluorohexanes, fluorocyclohexanes, fluoropentanes, fluorocyclopentanes, fluoromethylcyclopentanes, fluorodimethylcyclopentanes, fluoromethylcyclobutanes, fluorodimethylcyclobutanes, fluorotrimethylcyclobutanes, fluorobutanes, fluorocyclobutanse, fluoropropanes, fluoroethers, fluoropolyethers, fluorotriethylamines, perfluorohexanes, perfluoropentanes, perfluorobutanes, perfluoropropanes, sulfur hexafluoride, and the like.

Additional cannabinoid derivatives and cannabinoid precursor derivatives that can be produced with a method or genetically modified host cell of the present disclosure may include derivatives that have been modified via organic synthesis or an enzymatic route to modify drug metabolism and pharmacokinetics (e.g. solubility, bioavailability, absorption, distribution, plasma half-life and metabolic clearance). Modification examples may include, but are not limited to, halogenation, acetylation and methylation.

The cannabinoids, cannabinoid derivatives, cannabinoid precursors, and cannabinoid precursor derivatives described herein further include all pharmaceutically acceptable isotopically labeled cannabinoids, cannabinoid derivatives, cannabinoid precursors, and cannabinoid precursor derivatives. An "isotopically-" or "radio-labeled" compound is a compound where one or more atoms are replaced or substituted by an atom having an atomic mass or mass number different from the atomic mass or mass number typically found in nature (i.e., naturally occurring). For example, in some embodiments, in the cannabinoids, cannabinoid derivatives, cannabinoid precursors, and cannabinoid precursor derivatives described herein hydrogen atoms are replaced or substituted by one or more deuterium or tritium. Certain isotopically labeled cannabinoids, cannabinoid derivatives, cannabinoid precursors, and cannabinoid precursor derivatives of this disclosure, for example, those incorporating a radioactive isotope, are useful in drug and/or substrate tissue distribution studies. The radioactive isotopes tritium, i.e., $^3H$, and carbon 14, i.e., $^{14}C$, are particularly useful for this purpose in view of their ease of incorporation and ready means of detection. Substitution with heavier isotopes such as deuterium, i.e., $^2H$, may afford certain therapeutic advantages resulting from greater metabolic stability, for example, increased in vivo half-life or reduced dosage requirements, and hence may be preferred in some circumstances. Suitable isotopes that may be incorporated in cannabinoids, cannabinoid derivatives, cannabinoid precursors, and cannabinoid precursor derivatives described herein include but are not limited to $^2H$ (also written as D for deuterium), $^3H$ (also written as T for tritium), $^{11}C$, $^{13}C$, $^{14}C$, $^{13}N$, $^{15}N$, $^{15}O$, $^{17}O$, $^{18}O$, $^{18}F$, $^{35}S$, $^{36}Cl$, $^{82}Br$, $^{75}Br$, $^{76}Br$, $^{77}Br$, $^{123}I$, $^{124}I$, $^{125}I$, and $^{131}I$. Substitution with positron emitting isotopes, such as $^{11}C$, $^{18}F$, $^{15}O$, and $^{13}N$, can be useful in Positron Emission Topography (PET) studies.

The methods of bioproduction disclosed herein enable synthesis of cannabinoids, cannabinoid derivatives, cannabinoid precursors, or cannabinoid precursor derivatives with defined stereochemistries, which is challenging to do using chemical synthesis. Cannabinoids, cannabinoid derivatives, cannabinoid precursors, or cannabinoid precursor derivatives disclosed herein may be enantiomers or diastereomers. The term "enantiomers" may refer to a pair of stereoisomers which are non-superimposable mirror images of one another. In some embodiments the cannabinoids, cannabinoid derivatives, cannabinoid precursors, or cannabinoid precursor derivatives may be the (S)-enantiomer. In some embodiments the cannabinoids, cannabinoid derivatives, cannabinoid precursors, or cannabinoid precursor derivatives may be the (R)-enantiomer. In some embodiments, the cannabinoids, cannabinoid derivatives, cannabinoid precursors, or cannabinoid precursor derivatives may be the (+) or (−) enantiomers. The term "diastereomers" may refer to the set of stereoisomers which cannot be made superimposable by rotation around single bonds. For example, cis- and trans-double bonds, endo- and exo-substitution on bicyclic ring systems, and compounds containing multiple stereogenic centers with different relative configurations may be considered to be diastereomers. The term "diastereomer" may refer to any member of this set of compounds. Cannabinoids, cannabinoid derivatives, cannabinoid precursors, or cannabinoid precursor derivatives disclosed herein may include a double bond or a fused ring. In certain such embodiments, the double bond or fused ring may be cis or trans, unless the configuration is specifically defined. If the cannabinoid, cannabinoid derivative, cannabinoid precursor, or cannabinoid precursor derivative contains a double bond, the substituent may be in the E or Z configuration, unless the configuration is specifically defined.

In some embodiments when the cannabinoid, cannabinoid precursor, cannabinoid precursor derivative, or cannabinoid derivative is recovered from the cell lysate, from the culture medium, from both the cell lysate and the culture medium, or from a cell-free reaction mixture comprising one or more polypeptides disclosed herein, the recovered cannabinoid, cannabinoid precursor, cannabinoid precursor derivative, or cannabinoid derivative is in the form of a salt. In certain such embodiments, the salt is a pharmaceutically acceptable salt. In some embodiments, the salt of the recovered cannabinoid, cannabinoid precursor, cannabinoid precursor derivative, or cannabinoid derivative is then purified as disclosed herein.

The disclosure includes pharmaceutically acceptable salts of the cannabinoids, cannabinoid derivatives, cannabinoid precursors, and cannabinoid precursor derivatives described herein. "Pharmaceutically acceptable salts" refer to those salts which retain the biological effectiveness and properties of the free bases, which are not biologically or otherwise undesirable. Representative pharmaceutically acceptable salts include, but are not limited to, e.g., water-soluble and water-insoluble salts, such as the acetate, amsonate (4,4-diaminostilbene-2,2-disulfonate), benzenesulfonate, benzonate, bicarbonate, bisulfate, bitartrate, borate, bromide, butyrate, calcium, calcium edetate, camsylate, carbonate, chloride, citrate, clavulariate, dihydrochloride, edetate, edisylate, estolate, esylate, fiunarate, gluceptate, gluconate, glutamate, glycollylarsanilate, hexafluorophosphate, hexylresorcinate, hydrabamine, hydrobromide, hydrochloride, hydroxynaphthoate, iodide, sethionate, lactate, lactobionate, laurate, magnesium, malate, maleate, mandelate, mesylate, methylbromide, methylnitrate, methylsulfate, mucate, napsylate, nitrate, N-methylglucamine ammonium salt, 3-hydroxy-2-naphthoate, oleate, oxalate, palmitate, pamoate (1,1-methene-bis-2-hydroxy-3-naphthoate, einbonate), pantothenate, phosphate/diphosphate, picrate, polygalacturonate, propionate, p-toluenesulfonate, salicylate, stearate, subacetate, succinate, sulfate, sulfosalicylate, suramate, tannate, tartrate, teoclate, tosylate, triethiodide, and valerate salts.

"Pharmaceutically acceptable salt" also includes both acid and base addition salts. "Pharmaceutically acceptable acid addition salt" refers to those salts Which retain the biological effectiveness and properties of the free bases, which are not biologically or otherwise undesirable, and which are formed with inorganic acids such as, but are not limited to, hydrochloric acid, hydrobromic acid, sulfuric acid, nitric acid, phosphoric acid and the like, and organic acids such as, but not limited to, acetic acid, 2,2-dichloroacetic acid, adipic acid, alginic acid, ascorbic acid, aspartic acid, benzenesulfonic acid, benzoic acid, 4-acetamidobenzoic acid, camphoric acid, camphor-10-sulfonic acid, capric acid, caproic acid, caprylic acid, carbonic acid, cinnamic acid, citric acid, cyclamic acid, dodecylsulfuric acid, ethane-1,2-disulfonic acid, ethanesulfonic acid, 2-hydroxyethane-sulfonic acid, formic acid, fumaric acid, galactaric acid, gentisic acid, glucoheptonic acid, gluconic acid, glucuronic acid, glutamic acid, glutaric acid, 2-oxo-glutaric acid, glycerophosphoric acid, glycolic acid, hippuric acid, isobutyric acid, lactic acid, lactobionic acid, lauric acid, maleic acid, malic acid, malonic acid, mandelic acid, methanesulfonic acid, mucic acid, naphthalene-1,5-disulfonic acid, naphthalene-2-sulfonic acid, 1-hydroxy-2-naphthoic acid, nicotinic acid, oleic acid, orotic acid, oxalic acid, palmitic acid, pamoic acid, propionic acid, pyroglutamic acid, pyruvic acid, salicylic acid, 4-aminosalicylic acid, sebacic acid, stearic acid, succinic acid, tartaric acid, thiocyanic acid, p-toluenesulfonic acid, trifluoroacetic acid, undecylenic acid, and the like.

"Pharmaceutically acceptable base addition salt" refers to those salts which retain the biological effectiveness and properties of the free acids, which are not biologically or otherwise undesirable. These salts are prepared from addition of an inorganic base or an organic base to the free acid. Salts derived from inorganic bases include, but are not limited to, the sodium, potassium, lithium, ammonium, calcium, magnesium, iron, zinc, copper, manganese, aluminum salts and the like. For example, inorganic salts include, but are not limited to, ammonium, sodium, potassium, calcium, and magnesium salts. Salts derived from organic bases include, but are not limited to, salts of primary, secondary, and tertiary amines, substituted amines including naturally occurring substituted amines, cyclic amines and basic ion exchange resins, such as ammonia, isopropylamine, trimethylamine, diethylamine, triethylamine, tripropylamine, diethanolamine, ethanolamine, deanol, 2-dimethylaminoethanol, 2-diethylaminoethanol, dicyclohexylamine, lysine, arginine, histidine, caffeine, procaine, hydrabamine, choline, betaine, benethamine, benzathine, ethylenediamine, glucosamine, methylglucamine, theobromine, triethanolamine, tromethamine, purines, piperazine, piperidine, N-ethylpiperidine, polyamine resins and the like.

Methods of Using Host Cells to Generate Cannabinoids, Cannabinoid Precursors, Cannabinoid Derivatives, or Cannabinoid Precursor Derivatives The disclosure provides methods of producing a cannabinoid, a cannabinoid precursor, a cannabinoid precursor derivative, or a cannabinoid derivative in a genetically modified host cell, the method comprising: culturing a genetically modified host cell of the disclosure in a suitable medium and recovering the produced cannabinoid, cannabinoid precursor, cannabinoid precursor derivative, or cannabinoid derivative. In certain such embodiments, the produced cannabinoid, cannabinoid precursor, cannabinoid precursor derivative, or cannabinoid derivative is then purified as disclosed herein.

In some embodiments, culturing of the genetically modified host cells of the disclosure in a suitable medium provides for synthesis of a cannabinoid, a cannabinoid derivative, a cannabinoid precursor, or a cannabinoid precursor derivative in an increased amount compared to a non-genetically modified host cell cultured under similar conditions.

The disclosure provides methods of producing a cannabinoid, a cannabinoid precursor, a cannabinoid precursor derivative, or a cannabinoid derivative, the method comprising: culturing a genetically modified host cell of the disclosure in a suitable medium comprising a carboxylic acid and recovering the produced cannabinoid, cannabinoid precursor, cannabinoid precursor derivative, or cannabinoid derivative. In certain such embodiments, the produced cannabinoid, cannabinoid precursor, cannabinoid precursor derivative, or cannabinoid derivative is then purified as disclosed herein.

In some embodiments, the cannabinoid, cannabinoid precursor, cannabinoid precursor derivative, or cannabinoid derivative is recovered from the cell lysate, from the culture medium, or from both the cell lysate and the culture medium. In certain such embodiments, the recovered cannabinoid, cannabinoid precursor, cannabinoid precursor derivative, or cannabinoid derivative is then purified as disclosed herein.

The disclosure provides methods of producing a cannabinoid or a cannabinoid derivative in a genetically modified host cell, the method comprising: culturing a genetically modified host cell of the disclosure in a suitable medium and recovering the produced cannabinoid or cannabinoid derivative. In certain such embodiments, the produced cannabinoid or cannabinoid derivative is then purified as disclosed herein.

In some embodiments, culturing of the genetically modified host cells of the disclosure in a suitable medium provides for synthesis of a cannabinoid or a cannabinoid derivative in an increased amount compared to a non-genetically modified host cell cultured under similar conditions.

The disclosure provides methods of producing a cannabinoid or a cannabinoid derivative, the method comprising: culturing a genetically modified host cell of the disclosure in a suitable medium comprising a carboxylic acid and recovering the produced cannabinoid or cannabinoid derivative. In certain such embodiments, the produced cannabinoid or cannabinoid derivative is then purified as disclosed herein.

In some embodiments, the cannabinoid or cannabinoid derivative is recovered from the cell lysate, from the culture medium, or from both the cell lysate and the culture medium. In certain such embodiments, the recovered cannabinoid or cannabinoid derivative is then purified as disclosed herein.

In some embodiments, the genetically modified host cell of the present disclosure is cultured in a suitable medium comprising a carboxylic acid to generate an acyl-CoA compound or an acyl-CoA compound derivative. In certain such embodiments, the genetically modified host cell is genetically modified with one or more heterologous nucleic acids encoding an AAE polypeptide, a FAA polypeptide, or a fatty acyl-CoA ligase polypeptide, as described herein. In some embodiments, the genetically modified host cells of the present disclosure may further convert an acyl-CoA compound or an acyl-CoA compound derivative to cannabinoids, cannabinoid precursors, cannabinoid precursor derivatives, or cannabinoid derivatives.

Carboxylic acids may include, but are not limited to, $C_3$-$C_{18}$ fatty acids, butyric acid, isobutyric acid, valeric acid, hexanoic acid, heptanoic acid, octanoic acid, nonanoic acid, decanoic acid, undecanoic acid, lauric acid, myristic acid, $C_{15}$-$C_{18}$ fatty acids, fumaric acid, itaconic acid, malic acid, succinic acid, maleic acid, malonic acid, glutaric acid, glucaric acid, oxalic acid, adipic acid, pimelic acid, suberic acid, azelaic acid, sebacic acid, dodecanedioic acid, glutaconic acid, ortho-phthalic acid, isophthalic acid, terephthalic acid, citric acid, isocitric acid, aconitic acid, tricarballylic acid, and trimesic acid. Carboxylic acids may include $C_4$-$C_{10}$ carboxylic acids. In some embodiments, the carboxylic acid is a $C_4$ carboxylic acid. In some embodiments, the carboxylic acid is a $C_5$ carboxylic acid. In some embodiments, the carboxylic acid is a $C_6$ carboxylic acid. In some embodiments, the carboxylic acid is a $C_7$ carboxylic acid. In some embodiments, the carboxylic acid is a $C_8$ carboxylic acid. In some embodiments, the carboxylic acid is a $C_9$ carboxylic acid. In some embodiments, the carboxylic acid is a $C_{10}$ carboxylic acid. In some embodiments, the carboxylic acid is butyric acid. In some embodiments, the carboxylic acid is valeric acid. In some embodiments, the carboxylic acid is hexanoic acid. In some embodiments, the carboxylic acid is heptanoic acid. In some embodiments, the carboxylic acid is octanoic acid. In some embodiments, the carboxylic acid is nonanoic acid. In some embodiments, the carboxylic acid is decanoic acid. See, e.g., FIG. 12.

In some embodiments, the carboxylic acid comprises one or more functional and/or reactive groups to generate derivatives of hexanoyl-CoA or derivatives of acyl-CoA compounds. Functional groups may include, but are not limited to, azido, halo (e.g., chloride, bromide, iodide, fluorine), methyl, alkyl, alkynyl, alkenyl, methoxy, alkoxy, acetyl, amino, carboxyl, carbonyl, oxo, ester, hydroxyl, thio, cyano, aryl, heteroaryl, cycloalkyl, cycloalkenyl, cycloalkylalkenyl, cycloalkylalkynyl, cycloalkenylalkyl, cycloalkenylalkenyl, cycloalkenylalkynyl, heterocyclylalkenyl, heterocyclylalkynyl, heteroarylalkenyl, heteroarylalkynyl, arylalkenyl, arylalkynyl, spirocyclyl, heterospirocyclyl, heterocyclyl, thioalkyl, sulfone, sulfonyl, sulfoxide, amido, alkylamino, dialkylamino, arylamino, alkylarylamino, diarylamino, N-oxide, imide, enamine, imine, oxime, hydrazone, nitrile, aralkyl, cycloalkylalkyl, haloalkyl, heterocyclylalkyl, heteroarylalkyl, nitro, thioxo, and the like. See, e.g., FIGS. 12 and 13. Reactive groups may include, but are not necessarily limited to, azide, halogen, carboxyl, carbonyl, amine, (e.g., alkyl amine (e.g., lower alkyl amine), aryl amine), ester (e.g., alkyl ester (e.g., lower alkyl ester, benzyl ester), aryl ester, substituted aryl ester), cyano, thioester, thioether, sulfonyl halide, alcohol, thiol, succinimidyl ester, isothiocyanate, iodoacetamide, maleimide, hydrazine, alkynyl, alkenyl, and the like. In some embodiments, the reactive group is selected from a carboxyl, a carbonyl, an amine, an ester, thioester, thioether, a sulfonyl halide, an alcohol, a thiol, a succinimidyl ester, an isothiocyanate, am iodoacetamide, a maleimide, an azide, an alkyne, an alkene, and a hydrazine. Functional and reactive groups may be optionally substituted with one or more additional functional or reactive groups.

In some embodiments, the carboxylic acid is isotopically- or radio-labeled. In some embodiments, the carboxylic acid may be an enantiomer or diastereomer. In some embodiments the carboxylic acid may be the (S)-enantiomer. In some embodiments the carboxylic acid may be the (R)-enantiomer. In some embodiments, the carboxylic acid may be the (+) or (−) enantiomer. In some embodiments, the carboxylic acid may include a double bond or a fused ring. In certain such embodiments, the double bond or fused ring may be cis or trans, unless the configuration is specifically defined. If the carboxylic acid contains a double bond, the substituent may be in the E or Z configuration, unless the configuration is specifically defined.

In some embodiments, the carboxylic acid comprises a C=C group. In some embodiments, the carboxylic acid comprises an alkyne group. In some embodiments, the carboxylic acid comprises an $N_3$ group. In some embodiments, the carboxylic acid comprises a halogen. In some embodiments, the carboxylic acid comprises a CN group. In some embodiments, the carboxylic acid comprises an iodide. In some embodiments, the carboxylic acid comprises a bromide. In some embodiments, the carboxylic acid comprises chloride. In some embodiments, the carboxylic acid comprises fluoride. In some embodiments, the carboxylic acid comprises a carbonyl. In some embodiments, the carboxylic acid comprises an acetyl. In some embodiments, the carboxylic acid comprises an alkyl group.

Carboxylic acids may include, but are not limited to, 2-methylhexanoic acid, 3-methylhexanoic acid, 4-methylhexanoic acid, 5-methylhexanoic acid, 2-hexenoic acid, 3-hexenoic acid, 4-hexenoic acid, 5-hexenoic acid, 5-chlorovaleric acid, 5-aminovaleric acid, 5-cyanovaleric acid, 5-(methylsulfanyl)valeric acid, 5-hydroxyvaleric acid, 5-phenylvaleric acid, 2,3-dimethylhexanoic acid, $d_3$-hexanoic acid, 5-chloropentanoic acid, 5-(methylsulfanyl)pentanoic acid, 4-pentynoic acid, trans-2-pentenoic acid, 5-hexynoic acid, trans-2-hexenoic acid, 6-heptynoic acid, trans-2-octenoic acid, trans-2-nonenoic acid, 4-phenylbutyric acid, 6-phenylhexanoic acid, 7-phenylheptanoic acid, and the like. In some embodiments, the carboxylic acid is 2-methylhexanoic acid. In some embodiments, the carboxylic acid is 3-methylhexanoic acid. In some embodiments, the carboxylic acid is 4-methylhexanoic acid. In some embodiments, the carboxylic acid is 5-methylhexanoic acid. In some embodiments, the carboxylic acid is 2-hexenoic acid. In some embodiments, the carboxylic acid is 3-hexenoic acid. In some embodiments, the carboxylic acid is 4-hexenoic acid. In some embodiments, the carboxylic acid is 5-hexenoic acid. In some embodiments, the carboxylic acid is 5-chlorovaleric acid. In some embodiments, the carboxylic acid is 5-aminovaleric acid. In some embodiments, the carboxylic acid is 5-cyanovaleric acid. In some embodiments, the carboxylic acid is 5-(methylsulfanyl)valeric acid. In some embodiments, the carboxylic acid is 5-hydroxyvaleric acid. In some embodiments, the carboxylic acid is 5-phenylvaleric acid. In some embodiments, the carboxylic acid is 2,3-dimethylhexanoic acid. In some embodiments, the carboxylic acid is $d_3$-hexanoic acid. In some embodiments, the carboxylic acid is 5-chloropentanoic acid. In some embodiments, the carboxylic acid is 5-(methylsulfanyl)pentanoic acid. In some embodiments, the carboxylic acid is 4-pentynoic acid. In some embodiments, the carboxylic acid is trans-2-pentenoic acid. In some embodiments, the carboxylic acid is 5-hexynoic acid. In some embodiments, the carboxylic acid is trans-2-hexenoic acid. In some embodiments, the carboxylic acid is 6-heptynoic acid. In some embodiments, the carboxylic acid is trans-2-octenoic acid. In some embodiments, the carboxylic acid is trans-2-nonenoic acid. In some embodiments, the carboxylic acid is 4-phenylbutyric acid. In some embodiments, the carboxylic acid is 6-phenylhexanoic acid. In some embodiments, the carboxylic acid is 7-phenylheptanoic acid.

The disclosure also provides methods of producing the following cannabinoid precursor or precursor derivatives: olivetolic acid or olivetolic acid derivatives. In certain such embodiments, the method comprises: culturing a genetically modified host cell of the disclosure in a suitable medium comprising a carboxylic acid, and recovering the produced olivetolic acid or olivetolic acid derivative. In certain such embodiments, the genetically modified host cell of the disclosure is genetically modified with: a) one or more heterologous nucleic acids encoding a polypeptide that generates an acyl-CoA compound or an acyl-CoA compound derivative, such as an AAE polypeptide, a FAA polypeptide, or a fatty acyl-CoA ligase polypeptide; b) one or more heterologous nucleic acids encoding a TKS polypeptide; and c) one or more heterologous nucleic acids encoding an OAC polypeptide. In some embodiments, the genetically modified host cell is genetically modified with: a) one or more heterologous nucleic acids encoding a polypeptide that generates an acyl-CoA compound or an acyl-CoA compound derivative, such as an AAE polypeptide, a FAA polypeptide, or a fatty acyl-CoA ligase polypeptide; and b) one or more heterologous nucleic acids encoding a TKS/OAC fusion polypeptide.

In some embodiments, the olivetolic acid derivative produced by the methods or genetically modified host cells of the disclosure has the following formula:

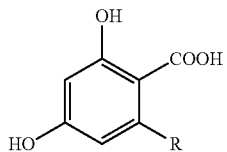

where R is alkyl (e.g., $C_1$-$C_{10}$ alkyl), substituted alkyl, alkyl ester, or alkyl-X, where X is a reactive or functional group, as disclosed herein. In some embodiments, the olivetolic acid or olivetolic acid derivative is recovered from the cell lysate, from the culture medium, or from both the cell lysate and the culture medium. In certain such embodiments, the recovered olivetolic acid or olivetolic acid derivative is then purified as disclosed herein. In some embodiments, the olivetolic acid or olivetolic acid derivative is further converted by the genetically modified host cell to a cannabinoid derivative or a cannabinoid.

The disclosure also provides methods of producing a cannabinoid or a cannabinoid derivative, the method comprising: culturing a genetically modified host cell of the disclosure in a suitable medium comprising olivetolic acid or an olivetolic acid derivative and recovering the produced cannabinoid or cannabinoid derivative. In certain such embodiments, the produced cannabinoid or cannabinoid derivative is then purified as disclosed herein. The disclosure also provides methods of producing a cannabinoid derivative, the method comprising: culturing a genetically modified host cell of the disclosure in a suitable medium comprising olivetolic acid or an olivetolic acid derivative and recovering the produced cannabinoid derivative. In certain such embodiments, the produced cannabinoid derivative is then purified as disclosed herein.

In some embodiments, the genetically modified host cell is genetically modified with: a) one or more heterologous nucleic acids that encode a GOT polypeptide and b) one or more heterologous nucleic acids that encode a polypeptide that generates GPP (e.g., a GPPS polypeptide). In some embodiments, the olivetolic acid or olivetolic acid derivative is further converted to a cannabinoid derivative or a cannabinoid.

Olivetolic acid derivatives used herein may comprise one or more reactive and/or functional groups as disclosed herein. In some embodiments when the suitable medium comprises an olivetolic acid derivative, the olivetolic acid derivative is orsellinic acid. In some embodiments when the suitable medium comprises an olivetolic acid derivative, the olivetolic acid derivative is divarinic acid.

In some embodiments, a method of producing a cannabinoid, a cannabinoid derivative, a cannabinoid precursor, or a cannabinoid precursor derivative may involve growing a transgenic (genetically modified) plant of the present disclosure under conditions that favor production of the cannabinoid, cannabinoid derivative, cannabinoid precursor, or cannabinoid precursor derivative. The cannabinoid, cannabinoid derivative, cannabinoid precursor, or cannabinoid precursor derivative can be purified from the plant, or a part of the plant. The present disclosure provides food products made from a transgenic (genetically modified) plant of the present disclosure.

Exemplary Cell Culture Conditions

Suitable media may include standard culture media (e.g., Luria-Bertani broth, optionally supplemented with one or more additional agents, such as an inducer (e.g., where heterologous nucleic acids disclosed herein is under the control of an inducible promoter, etc.); standard yeast culture media; and the like). In some embodiments, the culture medium can be supplemented with a fermentable sugar (e.g., a hexose sugar, e.g., glucose, xylose, and the like). In some embodiments, the culture medium can be supplemented with hexanoate, carboxylic acids other than hexanoate, olivetolic acid, or olivetolic acid derivatives. In some embodiments, the culture medium can be supplemented with pretreated cellulosic feedstock (e.g., wheat grass, wheat straw, barley straw, sorghum, rice grass, sugarcane straw, bagasse, switchgrass, corn stover, corn fiber, grains, or any combination thereof). In some embodiments, the culture medium can be supplemented with oleic acid. In some embodiments, the suitable medium comprises a non-fermentable carbon source. In certain such embodiments, the non-fermentable carbon source comprises ethanol. In some embodiments, the suitable media comprises an inducer. In certain such embodiments, the inducer comprises galactose.

The carbon source in the suitable media can vary significantly, from simple sugars like glucose to more complex hydrolysates of other biomass, such as yeast extract. The addition of salts generally provide essential elements such as magnesium, nitrogen, phosphorus, and sulfur to allow the cells to synthesize polypeptides and nucleic acids. The suitable media can also be supplemented with selective agents, such as antibiotics, to select for the maintenance of certain plasmids and the like. For example, if a microorganism is resistant to a certain antibiotic, such as ampicillin or tetracycline, then that antibiotic can be added to the medium in order to prevent cells lacking the resistance from growing. The suitable media can be supplemented with other compounds as necessary to select for desired physiological or biochemical characteristics, such as particular amino acids and the like.

In some embodiments, genetically modified host cells disclosed herein are grown in minimal medium. As used herein, the terms "minimal medium" or "minimal media" may refer to growth medium containing the minimum nutrients possible for cell growth, generally, but not always, without the presence of one or more amino acids (e.g., 2, 3, 4, 5, 6, 7, 8, 9, 10, or more amino acids). Minimal medium typically contains: (1) a carbon source for cellular (e.g. bacterial or yeast) growth; (2) various salts, which can vary among cellular (e.g. bacterial or yeast) species and growing conditions; and (3) water.

In some embodiments, genetically modified host cells disclosed herein are grown in rich medium or rich media. In certain such embodiments, the rich medium or rich media comprises yeast extract peptone dextrose (YPD) media comprising water, 10 g/L yeast extract, 20 g/L Bacto peptone, and 20 g/L dextrose (glucose). In some embodiments, the rich medium or rich media comprises YP+20 g/L galactose and 1 g/L glucose. In some embodiments, the rich medium or rich media further comprises a carboxylic acid (e.g., 1 mM olivetolic acid, 1 mM olivetolic acid derivative, 2 mM hexanoic acid, or 2 mM of a carboxylic acid other than hexanoic acid). In some embodiments, rich medium or rich media affords more rapid cell growth compared to minimal media or minimal medium.

Materials and methods suitable for the maintenance and growth of the recombinant cells of the disclosure are described herein, e.g., in the Examples section. Other materials and methods suitable for the maintenance and growth of cell (e.g. bacterial or yeast) cultures are well known in the art. Exemplary techniques can be found in International Publication No. WO2009/076676, U.S. patent application Ser. No. 12/335,071 (U.S. Publ. No. 2009/0203102), WO 2010/003007, US Publ. No. 2010/0048964, WO 2009/132220, US Publ. No. 2010/0003716, Manual of Methods for General Bacteriology Gerhardt et al, eds), American Society for Microbiology, Washington, D.C. (1994) or Brock in Biotechnology: A Textbook of Industrial Microbiology, Second. Edition (1989) Sinauer Associates, Inc., Sunderland, Mass.

Standard cell culture conditions can be used to culture the genetically modified host cells disclosed herein (see, for example, WO 2004/033646 and references cited therein). In some embodiments, cells are grown and maintained at an appropriate temperature, gas mixture, and pH (such as at about 20° C. to about 37° C., at about 0.04% to about 84% $CO_2$, at about 0% to about 100% dissolved oxygen, and at a pH between about 2 to about 9). In some embodiments, genetically modified host cells disclosed herein are grown at about 34° C. in a suitable cell culture medium. In some embodiments, genetically modified host cells disclosed herein are grown at about 20° C. to about 37° C. in a suitable cell culture medium. In some embodiments, genetically modified host cells disclosed herein are grown at about 20° C., about 21° C., about 22° C., about 23° C., about 24° C., about 25° C., about 26° C., about 27° C., about 28° C., about 29° C., about 30° C., about 31° C., about 32° C., about 33° C., about 34° C., about 35° C., about 36° C., or about 37° C. in a suitable cell culture medium. In some embodiments, the pH ranges for fermentation are between about pH 3.0 to about pH 9.0 (such as about pH 3.0, about pH 3.5, about pH 4.0, about pH 4.5, about pH 5.0, about pH 5.5, about pH 6.0, about pH 6.5, about pH 7.0, about pH 7.5, about pH 8.0, about pH 8.5, about pH 6.0 to about pH 8.0 or about 6.5 to about 7.0). In some embodiments, the pH ranges for fermentation are between about pH 4.5 to about pH 5.5. In some embodiments, the pH ranges for fermentation are between about pH 4.0 to about pH 6.0. In some embodiments, the pH ranges for fermentation are between about pH 3.0 to about pH 6.0. In some embodiments, the pH ranges for fermentation are between about pH 3.0 to about pH 5.5. In some embodiments, the pH ranges for fermentation are between about 3.0 to about pH 5.0. In some embodiments, the dissolved oxygen is between about 0% to about 10%, about 0% to about 20%, about 0% to about 30%, about 0% to about 40%, about 0% to about 50%, about 0% to about 60%, about 0% to about 70%, about 0% to about 80%, about 0% to about 90%, about 5% to about 10%, about 5% to about 20%, about 5% to about 30%, about 5% to about 40%, about 5% to about 50%, about 5% to about 60%, about 5% to about 70%, about 5% to about 80%, about 5% to about 90%, about 10% to about 20%, about 10% to about 30%, about 10% to about 40% or about 10% to about 50%. In some embodiments, the $CO_2$ level is between about 0.04% to about 0.1% $CO_2$, about 0.04% to about 1% $CO_2$, about 0.04% to about 5% $CO_2$, about 0.04% to about 10% $CO_2$, about 0.04% to about 20% $CO_2$, about 0.04% to about 30% $CO_2$, about 0.04% to about 40% $CO_2$, about 0.04% to about 50% $CO_2$, about 0.04% to about 60% $CO_2$, about 0.04% to about 70% $CO_2$, about 0.1% to about 5% $CO_2$, about 0.1% to about 10% $CO_2$, about 0.1% to about 20% $CO_2$, about 0.1% to about 30% $CO_2$, about 0.1% to about 40% $CO_2$, about 0.1% to about 50% $CO_2$, about 1% to about 5% $CO_2$, about 1% to about 10% $CO_2$, about 1% to about 20% $CO_2$, about 1% to about 30% $CO_2$, about 1% to about 40% $CO_2$, about 1% to about 50% $CO_2$, about 5% to about 10% $CO_2$, about 10% to about 20% $CO_2$, about 10% to about 30% $CO_2$, about 10% to about 40% $CO_2$, about 10% to about 50% $CO_2$, about 10% to about 60% $CO_2$, about 10% to about 70% $CO_2$, about 10% to about 80% $CO_2$, about 50% to about 60% $CO_2$, about 50% to about 70% $CO_2$, or about 50% to about 80% $CO_2$. genetically modified host cells disclosed herein disclosed herein can be grown under aerobic, anoxic, microaerobic, or anaerobic conditions based on the requirements of the cells.

Standard culture conditions and modes of fermentation, such as batch, fed-batch, or continuous fermentation that can be used are described in International Publication No. WO 2009/076676, U.S. patent application Ser. No. 12/335,071 (U.S. Publ. No. 2009/0203102), WO 2010/003007, US Publ. No. 2010/0048964, WO 2009/132220, US Publ. No. 2010/0003716, the contents of each of which are incorporated by reference herein in their entireties. Batch and Fed-Batch fermentations are common and well known in the art and examples can be found in Brock, Biotechnology: A Textbook of Industrial Microbiology, Second Edition (1989) Sinauer Associates, Inc.

Production and Recovery of Produced Cannabinoids, Cannabinoid Precursors, Cannabinoid Derivatives or Cannabinoid Precursor Derivatives In some embodiments, a method of the present disclosure provides for production of a cannabinoid, a cannabinoid derivative, a cannabinoid precursor, or a cannabinoid precursor derivative by genetically modified host cells of the disclosure in a recoverable amount of from about 1 mg/L culture medium to about 1 g/L culture medium. In some embodiments, a method of the present disclosure provides for production of a cannabinoid, a cannabinoid derivative, a cannabinoid precursor, or a cannabinoid precursor derivative in a recoverable amount of from about 1 mg/L culture medium to about 500 mg/L culture medium. In some embodiments, a method of the present disclosure provides for production of a cannabinoid, a cannabinoid derivative, a cannabinoid precursor, or a cannabinoid precursor derivative in a recoverable amount of from about 1 mg/L culture medium to about 100 mg/L culture medium. For example, in some embodiments, a method of the present disclosure provides for production of a cannabinoid, a cannabinoid derivative, a cannabinoid precursor, or a cannabinoid precursor derivative in a recoverable amount of from about 1 mg/L, culture medium to about 5 mg/L culture medium, from about 5 mg/L culture medium to about 10 mg/L culture medium, from about 10 mg/L culture medium to about 25 mg/L culture medium, from about 25 mg/L culture medium to about 50 mg/L culture medium, from about 50 mg/L culture medium to about 75 mg/L culture medium, or from about 75 mg/L culture medium to about 100 mg/L culture medium. In some embodiments, a method of the present disclosure provides for production of a cannabinoid, a cannabinoid derivative, a cannabinoid precursor, or a cannabinoid precursor derivative in a recoverable amount of from about 100 mg/L culture medium to about 150 mg/L culture medium, from about 150 mg/L culture medium to about 200 mg/L culture medium, from about 200 mg/L culture medium to about 250 mg/L culture medium, from about 250 mg/L culture medium to about 500 mg/L culture medium, from about 500 mg/L culture medium to about 750 mg/L culture medium, or from about 750 mg/L culture medium to about 1 g/L culture medium. In some embodiments, a method of the present disclosure provides for production of a cannabinoid, a cannabinoid derivative, a cannabinoid precursor, or a cannabinoid precursor derivative in a recoverable amount of from about from about 50 mg/L culture medium to about 100 mg/L culture medium, 50 mg/L culture medium to about 150 mg/L culture medium, from about 50 mg/L culture medium to about 200 mg/L culture medium, from about 50 mg/L culture medium to about 250 mg/L culture medium, from about 50 mg/L culture medium to about 500 mg/L culture medium, or from about 50 mg/L culture medium to about 750 mg/L culture medium.

In some embodiments, a method of the present disclosure provides for production of a cannabinoid, a cannabinoid derivative, a cannabinoid precursor, or a cannabinoid precursor derivative in a recoverable amount of from about 100 mg/L culture medium to about 500 mg/L culture medium, or more than 500 mg/L culture medium. In some embodiments, a method of the present disclosure provides for production of a cannabinoid, a cannabinoid derivative, a cannabinoid precursor, or a cannabinoid precursor derivative in a recoverable amount of from about 500 mg/L culture medium to about 1 g/L culture medium, or more than 1 g/L culture medium. In some embodiments, a method of the present disclosure provides for production of a cannabinoid, a cannabinoid derivative, a cannabinoid precursor, or a cannabinoid precursor derivative in a recoverable amount of from about 1 g/L culture medium to about 10 g/L culture medium, or more than 10 g/L culture medium. In some embodiments, a method of the present disclosure provides for production of a cannabinoid, a cannabinoid derivative, a cannabinoid precursor, or a cannabinoid precursor derivative in a recoverable amount of from about 10 g/L culture medium to about 100 g/L culture medium, or more than 100 g/L culture medium. In some embodiments, a method of the present disclosure provides for production of a cannabinoid, a cannabinoid derivative, a cannabinoid precursor, or a cannabinoid precursor derivative in a recoverable amount of from about 1 g/L culture medium to about 20 g/L culture medium, or more than 20 g/L culture medium. In some embodiments, a method of the present disclosure provides for production of a cannabinoid, a cannabinoid derivative, a cannabinoid precursor, or a cannabinoid precursor derivative in a recoverable amount of from about 1 g/L culture medium to about 30 g/L culture medium, or more than 30 g/L culture medium. In some embodiments, a method of the present disclosure provides for production of a cannabinoid, a cannabinoid derivative, a cannabinoid precursor, or a cannabinoid precursor derivative in a recoverable amount of from about 1 g/L culture medium to about 40 g/L culture medium, or more than 40 g/L culture medium. In some embodiments, a method of the present disclosure provides for production of a cannabinoid, a cannabinoid derivative, a cannabinoid precursor, or a cannabinoid precursor derivative in a recoverable amount of from about 1 g/L culture medium to about 50 g/L culture medium, or more than 50 g/L culture medium. In some embodiments, a method of the present disclosure provides for production of a cannabinoid, a cannabinoid derivative, a cannabinoid precursor, or a cannabinoid precursor derivative in a recoverable amount of from about 1 g/L culture medium to about 60 g/L culture medium, or more than 60 g/L culture medium. In some embodiments, a method of the present disclosure provides for production of a cannabinoid, a cannabinoid derivative, a cannabinoid precursor, or a cannabinoid precursor derivative in a recoverable amount of from about 1 g/L culture medium to about 70 g/L culture medium, or more than 70 g/L culture medium. In some embodiments, a method of the present disclosure provides for production of a cannabinoid, a cannabinoid derivative, a cannabinoid precursor, or a cannabinoid precursor derivative in a recoverable amount of from about 1 g/L culture medium to about 80 g/L culture medium, or more than 80 g/L culture medium. In some embodiments, a method of the present disclosure provides for production of a cannabinoid, a cannabinoid derivative, a cannabinoid precursor, or a cannabinoid precursor derivative in a recoverable amount of from about 1 g/L culture medium to about 90 g/L culture medium, or more than 90 g/L culture medium. In some embodiments, a method of the present disclosure provides for production of a cannabinoid, a cannabinoid derivative, a cannabinoid precursor, or a cannabinoid precursor derivative in a recoverable amount of from about 10 g/L culture medium to about 20 g/L culture medium, or more than 20 g/L culture medium. In some embodiments, a method of the present disclosure provides for production of a cannabinoid, a cannabinoid derivative, a cannabinoid precursor, or a cannabinoid precursor derivative in a recoverable amount of from about 10 g/L culture medium to about 30 g/L culture medium, or more than 30 g/L, culture medium. In some embodiments, a method of the present disclosure provides for production of a cannabinoid, a cannabinoid derivative, a cannabinoid precursor, or a cannabinoid precursor derivative in a recoverable amount of from about 10 g/L culture medium to about 40 g/L culture medium, or more than 40 g/L culture medium. In some embodiments, a method of the present disclosure provides for production of a cannabinoid, a cannabinoid derivative, a cannabinoid precursor, or a cannabinoid precursor derivative in a recoverable amount of from about 10 g/L culture medium to about 50 g/L culture medium, or more than 50 g/L culture medium. In some embodiments, a method of the present disclosure provides for production of a cannabinoid, a cannabinoid derivative, a cannabinoid precursor, or a cannabinoid precursor derivative in a recoverable amount of from about 10 g/L culture medium to about 60 g/L culture medium, or more than 60 g/L culture medium. In some embodiments, a method of the present disclosure provides for production of a cannabinoid, a cannabinoid derivative, a cannabinoid precursor, or a cannabinoid precursor derivative in a recoverable amount of from about 10 g/L culture medium to about 70 g/L, culture medium, or more than 70 g/L, culture medium. In some embodiments, a method of the present disclosure provides for production of a cannabinoid, a cannabinoid derivative, a cannabinoid precursor, or a cannabinoid precursor derivative in a recoverable amount of from about 10 g/L culture medium to about 80 g/L culture medium, or more than 80 g/L culture medium. In some embodiments, a method of the present disclosure provides for production of a cannabinoid, a cannabinoid derivative, a cannabinoid precursor, or a cannabinoid precursor derivative in a recoverable amount of from about 10 g/L culture medium to about 90 g/L culture medium, or more than 90 g/L culture medium. In some embodiments, a method of the present disclosure provides for production of a cannabinoid, a cannabinoid derivative, a cannabinoid precursor, or a cannabinoid precursor derivative in a recoverable amount of from about 50 g/L culture medium to about 100 g/L culture medium, or more than 100 g/L culture medium. In some embodiments, a method of the present disclosure provides for production of a cannabinoid, a cannabinoid derivative, a cannabinoid precursor, or a cannabinoid precursor derivative in a recoverable amount of from about 50 g/L culture medium to about 60 g/L culture medium, or more than 60 g/L culture medium. In some embodiments, a method of the present disclosure provides for production of a cannabinoid, a cannabinoid derivative, a cannabinoid precursor, or a cannabinoid precursor derivative in a recoverable amount of from about 50 g/L culture medium to about 70 g/L, culture medium, or more than 70 g/L, culture medium. In some embodiments, a method of the present disclosure provides for production of a cannabinoid, a cannabinoid derivative, a cannabinoid precursor, or a cannabinoid precursor derivative in a recoverable amount of from about 50 g/L culture medium to about 80 g/L culture medium, or more than 80 g/L culture medium. In some embodiments, a method of the present disclosure provides for production of a cannabinoid, a cannabinoid derivative, a cannabinoid precursor, or a cannabinoid precursor derivative in a recoverable amount of from about 50 g/L culture medium to about 90 g/L culture medium, or more than 90 g/L culture medium. In some embodiments, a method of the present disclosure provides for production of a cannabinoid, a cannabinoid derivative, a cannabinoid precursor, or a cannabinoid precursor derivative in a recoverable amount of from about 20 g/L culture medium to about 100 g/L culture medium, or more than 100 g/L culture medium. In some embodiments, a method of the present disclosure provides for production of a cannabinoid, a cannabinoid derivative, a cannabinoid precursor, or a cannabinoid precursor derivative in a recoverable amount of from about 20 g/L culture medium to about 30 g/L culture medium, or more than 30 g/L culture medium. In some embodiments, a method of the present disclosure provides for production of a cannabinoid, a cannabinoid derivative, a cannabinoid precursor, or a cannabinoid precursor derivative in a recoverable amount of from about 20 g/L culture medium to about 40 g/L culture medium, or more than 40 g/L culture medium. In some embodiments, a method of the present disclosure provides for production of a cannabinoid, a cannabinoid derivative, a cannabinoid precursor, or a cannabinoid precursor derivative in a recoverable amount of from about 20 g/L culture medium to about 50 g/L culture medium, or more than 50 g/L culture medium. In some embodiments, a method of the present disclosure provides for production of a cannabinoid, a cannabinoid derivative, a cannabinoid precursor, or a cannabinoid precursor derivative in a recoverable amount of from about 20 g/L culture medium to about 60 g/L culture medium, or more than 60 g/L culture medium. In some embodiments, a method of the present disclosure provides for production of a cannabinoid, a cannabinoid derivative, a cannabinoid precursor, or a cannabinoid precursor derivative in a recoverable amount of from about 20 g/L culture medium to about 70 g/L culture medium, or more than 70 g/L culture medium. In some embodiments, a method of the present disclosure provides for production of a cannabinoid, a cannabinoid derivative, a cannabinoid precursor, or a cannabinoid precursor derivative in a recoverable amount of from about 20 g/L culture medium to about 80 g/L culture medium, or more than 80 g/L culture medium. In some embodiments, a method of the present disclosure provides for production of a cannabinoid, a cannabinoid derivative, a cannabinoid precursor, or a cannabinoid precursor derivative in a recoverable amount of from about 20 g/L culture medium to about 90 g/L culture medium, or more than 90 g/L culture medium.

In some embodiments, the genetically modified host cell disclosed herein is cultured in a liquid medium comprising a precursor acid to generate acyl-CoA compounds or acyl-CoA compound derivatives. Suitable precursor acids may include, but are not limited to, carboxylic acids.

In some embodiments, a method of producing a cannabinoid, a cannabinoid derivative, cannabinoid precursor, cannabinoid precursor derivative, or cannabinoid precursor derivative may involve culturing a genetically modified yeast cell of the present disclosure under conditions that favor production of the cannabinoid, cannabinoid derivative, cannabinoid precursor, or cannabinoid precursor derivative; where the cannabinoid, cannabinoid derivative, cannabinoid precursor, or cannabinoid precursor derivative is produced by the genetically modified yeast cell and is present in the culture medium (e.g., a liquid culture medium) in which the genetically modified yeast cell is cultured. In some embodiments, the culture medium in which the genetically modified yeast cell is cultured comprises a cannabinoid, a cannabinoid derivative, a cannabinoid precursor, or a cannabinoid precursor derivative in an amount of from 1 ng/L to 1 g/L (e.g., from 1 ng/L to 50 ng/L, from 50 ng/L to 100 ng/L, from 100 ng/L to 500 ng/L, from 500 ng/L to 1 µg/L, from 1 µg/L to 50 µg/L, from 50 µg/L to 100 µg/L, from 100 µg/L to 500 µg/L, from 500 µg/L to 1 mg/L, from 1 mg/L to 50 mg/L, from 50 mg/L to 100 mg/L, from 100 mg/L to 500 mg/L, or from 500 mg/L to 1 g/L). In some embodiments, the culture medium in which the genetically modified yeast cell is cultured comprises a cannabinoid, a cannabinoid derivative, a cannabinoid precursor, or a cannabinoid precursor derivative in an amount more than 1 g/L.

In some embodiments, a method of producing a cannabinoid, a cannabinoid derivative, a cannabinoid precursor, or a cannabinoid precursor derivative may involve culturing a genetically modified yeast cell of the present disclosure under conditions that favor fermentation of a sugar, and under conditions that favor production of the cannabinoid, cannabinoid derivative, cannabinoid precursor, or cannabinoid precursor derivative; wherein the cannabinoid, cannabinoid derivative, cannabinoid precursor, or cannabinoid precursor derivative is produced by the genetically modified yeast cell and is present in alcohol produced by the genetically modified yeast cell. The present disclosure provides an alcoholic beverage produced by the genetically modified yeast cell, where the alcoholic beverage comprises the cannabinoid, cannabinoid derivative, cannabinoid precursor, or cannabinoid precursor derivative produced by the genetically modified yeast cell. Alcoholic beverages may include beer, wine, and distilled alcoholic beverages. In some embodiments, an alcoholic beverage of the present disclosure comprises a cannabinoid, cannabinoid derivative, cannabinoid precursor, or cannabinoid precursor derivative in an amount of from 1 ng/L to 1 g/L (e.g., from 1 ng/L to 50 ng/L, from 50 ng/L to 100 ng/L, from 100 ng/L to 500 ng/L, from 500 ng/L to 1 µg/L, from 1 µg/L to 50 µg/L, from 50 µg/L to 100 µg/L, from 100 µg/L to 500 µg/L, from 500 µg/L to 1 mg/L, from 1 mg/L to 50 mg/L, from 50 mg/L to 100 mg/L, from 100 mg/L to 500 mg/L, or from 500 mg/L to 1 g/L). In some embodiments, an alcoholic beverage of the present disclosure comprises a cannabinoid, cannabinoid derivative, cannabinoid precursor, or cannabinoid precursor derivative in an amount more than 1 g/L In some embodiments, a method of the present disclosure provides for increased production of a cannabinoid, a cannabinoid derivative, a cannabinoid precursor, or a cannabinoid precursor derivative. In certain such embodiments, culturing of the genetically modified host cell disclosed herein in a suitable medium provides for synthesis of the cannabinoid, the cannabinoid derivative, the cannabinoid precursor, or the cannabinoid precursor derivative in an increased amount compared to a non-genetically modified host cell cultured under similar conditions. The production of a cannabinoid, a cannabinoid derivative, a cannabinoid precursor, or a cannabinoid precursor derivative by the genetically modified host cells disclosed herein may be increased by about 5% to about 1,000,000 folds compared to a non-genetically modified host cell cultured under similar conditions. The production of a cannabinoid, a cannabinoid derivative, a cannabinoid precursor, or a cannabinoid precursor derivative by the genetically modified host cells disclosed herein may be increased by about 10% to about 1,000,000 folds (e.g., about 50% to about 1,000,000 folds, about 1 to about 500,000 folds, about 1 to about 50,000 folds, about 1 to about 5,000 folds, about 1 to about 1,000 folds, about 1 to about 500 folds, about 1 to about 100 folds, about 1 to about 50 folds, about 5 to about 100,000 folds, about 5 to about 10,000 folds, about 5 to about 1,000 folds, about 5 to about 500 folds, about 5 to about 100 folds, about 10 to about 50,000 folds, about 50 to about 10,000 folds, about 100 to about 5,000 folds, about 200 to about 1,000 folds, about 50 to about 500 folds, or about 50 to about 200 folds) compared to the production of a cannabinoid, a cannabinoid derivative, a cannabinoid precursor, or a cannabinoid precursor derivative by non-genetically modified host cells cultured under similar conditions. The production of a cannabinoid, a cannabinoid derivative, a cannabinoid precursor, or a cannabinoid precursor derivative by genetically modified host cells disclosed herein may also be increased by at least about any of 10%, 20%, 30%, 40%, 50%, 60%, 70%, 80%, 90%, 1 fold, 2 folds, 5 folds, 10 folds, 20 folds, 50 folds, 100 folds, 200 folds, 500 folds, 1000 folds, 2000 folds, 5000 folds, 10,000 folds, 20,000 folds, 50,000 folds, 100,000 folds, 200,000 folds, 500,000 folds, or 1,000,000 folds compared to the production of a cannabinoid, a cannabinoid derivative, a cannabinoid precursor, or a cannabinoid precursor derivative by non-genetically modified host cells cultured under similar conditions.

In some embodiments, the production of a cannabinoid, a cannabinoid derivative, a cannabinoid precursor, or a cannabinoid precursor derivative by genetically modified host cells of the disclosure may also be increased by at least about any of 10%, 20%, 30%, 40%, 50%, 60%, 70%, 80%, or 90% compared to the production of a cannabinoid, a cannabinoid derivative, a cannabinoid precursor, or a cannabinoid precursor derivative by non-genetically modified host cells cultured under similar conditions. In some embodiments, the production of a cannabinoid, a cannabinoid derivative, a cannabinoid precursor, or a cannabinoid precursor derivative by genetically modified host cells disclosed herein may also be increased by at least about any of 1-20%, 2-20%, 5-20%, 10-20%, 15-20%, 1-15%, 1-10%, 2-15%, 2-10%, 5-15%, 10-15%, 1-50%, 10-50%, 20-50%, 30-50%, 40-50%, 50-100%, 50-60%, 50-70%, 50-80%, or 50-90% compared to the production of a cannabinoid, a cannabinoid derivative, a cannabinoid precursor, or a cannabinoid precursor derivative by non-genetically modified host cells cultured under similar conditions.

In some embodiments, production of a cannabinoid, a cannabinoid derivative, a cannabinoid precursor, or a cannabinoid precursor derivative by genetically modified host cells of the disclosure is determined by LC-MS analysis. In certain such embodiments, each cannabinoid, cannabinoid precursor, cannabinoid derivative, or cannabinoid precursor derivative is identified by retention time, determined from an authentic standard, and multiple reaction monitoring (MRM) transition.

In some embodiments, the genetically modified host cell of the disclosure is yeast cell. In certain such embodiments, the genetically modified host cell disclosed herein is cultured in a bioreactor. In some embodiments, the genetically modified host cell is cultured in a suitable medium supplemented with hexanoic acid, a carboxylic acid other than hexanoic acid, olivetolic acid, or an olivetolic acid derivative.

In some embodiments, the cannabinoid, cannabinoid derivative, cannabinoid precursor, or cannabinoid precursor derivative is recovered from a cell lysate, e.g., by lysing the genetically modified host cell disclosed herein and recovering the cannabinoid, cannabinoid derivative, cannabinoid precursor, or cannabinoid precursor derivative from the lysate. In other cases, the cannabinoid, cannabinoid derivative, cannabinoid precursor, or cannabinoid precursor derivative is recovered from the culture medium in which the genetically modified host cell disclosed herein is cultured. In other cases, the cannabinoid, cannabinoid derivative, cannabinoid precursor, or cannabinoid precursor derivative is recovered from both the cell lysate and the culture medium.

In some embodiments, the recovered cannabinoid, cannabinoid derivative, cannabinoid precursor, or cannabinoid precursor derivative is then purified. In some embodiments, whole-cell broth from cultures comprising genetically modified host cells of the disclosure may be extracted with a suitable organic solvent to afford cannabinoids, cannabinoid precursors, cannabinoid derivatives, or cannabinoid precursor derivatives. Suitable organic solvents include, but are not limited to, hexane, heptane, ethyl acetate, petroleum ether, and di-ethyl ether, chloroform, and ethyl acetate. In some embodiments, the suitable organic solvent comprises hexane. In some embodiments, the suitable organic solvent may be added to the whole-cell broth from fermentations comprising genetically modified host cells of the disclosure at a 10:1 ratio (10 parts whole-cell broth-1 part organic solvent) and stirred for 30 minutes. In certain such embodiments, the organic fraction may be separated and extracted twice with an equal volume of acidic water (pH 2.5). The organic layer may then be separated and dried in a concentrator (rotary evaporator or thin film evaporator under reduced pressure) to obtain crude cannabinoid, cannabinoid precursor, cannabinoid derivative, or cannabinoid precursor derivative crystals. In certain such embodiments, the crude crystals may be heated to 105° C. for 15 minutes followed by 145° C. for 55 minutes to decarboxylate a crude cannabinoid or cannabinoid derivative. In certain such embodiments, the crude crystalline product may be re-dissolved and recrystallized in a suitable solvent (e.g., n-pentane) and filtered to remove any insoluble material. In certain such embodiments, the solvent may then be removed e.g. by rotary evaporation, to produce pure crystalline product.

In some embodiments, the cannabinoid, cannabinoid derivative, cannabinoid precursor, or cannabinoid precursor derivative is pure, e.g., at least about 40% pure, at least about 50% pure, at least about 60% pure, at least about 70% pure, at least about 80% pure, at least about 90% pure, at least about 95% pure, at least about 98%, or more than 98% pure, where "pure" in the context of a cannabinoid, cannabinoid derivative, cannabinoid precursor, or cannabinoid precursor derivative may refer to a cannabinoid, cannabinoid derivative, cannabinoid precursor, or cannabinoid precursor derivative that is free from other cannabinoids, cannabinoid derivatives, cannabinoid precursors, cannabinoid precursor derivatives macromolecules, contaminants, etc.

Cell-Free Methods of Generating Cannabinoids, Cannabinoid Precursors, Olivetolic Acid Derivatives, Olivetolic Acid, Cannabinoid Derivatives, or Cannabinoid Precursor Derivatives The methods of the disclosure may involve cell-free production of cannabinoids, cannabinoid precursors, cannabinoid precursor derivatives, or cannabinoid derivatives using one or more polypeptides disclosed herein expressed or overexpressed by a genetically modified host cell of the disclosure. In some embodiments, one or more polypeptides disclosed herein expressed or overexpressed by a genetically modified host cell of the disclosure are used in a cell-free system for the production of cannabinoids, cannabinoid precursors, cannabinoid precursor derivatives, or cannabinoid derivatives. In certain such embodiments, appropriate starting materials for use in producing cannabinoids, cannabinoid precursors, cannabinoid precursor derivatives, or cannabinoid derivatives may be mixed together with one or more polypeptides disclosed herein expressed or overexpressed by a genetically modified host cell of the disclosure in a suitable reaction vessel to effect the reaction. The one or more polypeptides disclosed herein expressed or overexpressed by a genetically modified host cell of the disclosure may be used in combination to effect a complete synthesis of a cannabinoid, cannabinoid precursor, cannabinoid precursor derivative, or cannabinoid derivative from the appropriate starting materials. In some embodiments, the cannabinoid, cannabinoid precursor, the cannabinoid precursor derivative, or cannabinoid derivative is recovered from a cell-free reaction mixture comprising one or more of the polypeptides disclosed herein.

In some embodiments, the recovered cannabinoids, cannabinoid precursors, cannabinoid precursor derivatives, or cannabinoid derivatives are then purified. In certain such embodiments, a cell-free reaction mixture comprising one or more of the polypeptides disclosed herein may be extracted with a suitable organic solvent to afford cannabinoids, cannabinoid precursors, cannabinoid derivatives, or cannabinoid precursor derivatives. Suitable organic solvents include, but are not limited to, hexane, heptane, ethyl acetate, petroleum ether, and di-ethyl ether, chloroform, and ethyl acetate. In some embodiments, the suitable organic solvent comprises hexane. In some embodiments, the suitable organic solvent may be added to the cell-free reaction mixture comprising one or more of the polypeptides disclosed herein at a 10:1 ratio (10 parts reaction mixture-1 part organic solvent) and stirred for 30 minutes. In certain such embodiments, the organic fraction may be separated and extracted twice with an equal volume of acidic water (pH 2.5). The organic layer may then be separated and dried in a concentrator (rotary evaporator or thin film evaporator under reduced pressure) to obtain crude cannabinoid, cannabinoid precursor, cannabinoid derivative, or cannabinoid precursor derivative crystals. In certain such embodiments, the crude crystals may be heated to 105° C. for 15 minutes followed by 145° C. for 55 minutes to decarboxylate a crude cannabinoid or cannabinoid derivative. In certain such embodiments, the crude crystalline product may be re-dissolved and recrystallized in a suitable solvent (e.g., n-pentane) and filtered to remove any insoluble material. In certain such embodiments, the solvent may then be removed e.g. by rotary evaporation, to produce pure crystalline product.

In some embodiments, a prenyl group acceptor molecule, a prenyl group donor molecule and a GOT polypeptide may be mixed together in a suitable reaction vessel to effect the reaction. In certain such embodiments, the GOT polypeptide can catalyze production of cannabigerolic acid from GPP and olivetolic acid in an amount at least ten times higher than a polypeptide comprising an amino acid sequence set forth in SEQ ID NO:82. In some embodiments, the GOT polypeptide comprises an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:100 or SEQ ID NO:110. In some embodiments, the prenyl group acceptor molecule is olivetolic acid or a derivative thereof. In some embodiments, the prenyl group donor molecule is GPP or a derivative thereof. In some embodiments, the reaction produces cannabigerolic acid or a derivative thereof.

In some embodiments, cell-free production of a cannabinoid, a cannabinoid derivative, a cannabinoid precursor, or a cannabinoid precursor derivative by one or more polypeptides disclosed herein expressed or overexpressed by a genetically modified host cell of the disclosure is determined by LC-MS analysis. In certain such embodiments, each cannabinoid, cannabinoid precursor, cannabinoid derivative, or cannabinoid precursor derivative is identified by retention time, determined from an authentic standard, and multiple reaction monitoring (MRM) transition.

Examples of Non-Limiting Embodiments of the Disclosure

Embodiments, of the present subject matter disclosed herein may be beneficial alone or in combination, with one or more other embodiments. Without limiting the foregoing description, certain non-limiting embodiments of the disclosure, numbered I-1 to I-54, II-1 to II-55, and III-1 to III-81 are provided below. As will be apparent to those of skill in the art upon reading this disclosure, each of the individually numbered embodiments may be used or combined with any of the preceding or following individually numbered embodiments. This is intended to provide support for all such combinations of embodiments and is not limited to combinations of embodiments explicitly provided below. Some embodiments of the disclosure are of Embodiment I:

Embodiment I-1. A genetically modified host cell that produces a cannabinoid compound or a cannabinoid precursor, wherein the genetically modified host cell is genetically modified with: a) one or more heterologous nucleic acids that encode one or more polypeptides that generate hexanoyl-CoA or derivatives of hexanoyl-CoA; b) one or more heterologous nucleic acids that encode one or more polypeptides that generate geranyl pyrophosphate; c) one or more heterologous nucleic acids that encode one or more polypeptides that generate malonyl-CoA; d) one or more heterologous nucleic acids that encode a fusion TKS/OAC polypeptide that condenses hexanoyl-CoA or its derivatives and malonyl-CoA to generate olivetolic acid or derivatives of olivetolic acid; e) one or more heterologous nucleic acids that encode a truncated geranyl pyrophosphate:olivetolic acid geranyltransferase (GOT) polypeptide or an NphB polypeptide; and f) one or more heterologous nucleic acids that encode a cannabinoid synthase polypeptide, wherein culturing of the genetically modified host cell in a suitable medium provides for synthesis of the cannabinoid compound or the cannabinoid precursor in a recoverable amount.

Embodiment I-2. The genetically modified host cell of Embodiment I-1, wherein the host cell is a eukaryotic cell.

Embodiment I-3. The genetically modified host cell of Embodiment I-2, wherein the host cell is a yeast cell.

Embodiment I-4. The genetically modified host cell of Embodiment I-3, wherein the host cell is *Saccharomyces cerevisiae*.

Embodiment I-5. The genetically modified host cell of Embodiment I-4, wherein the host cell is a protease-deficient strain of *Saccharomyces cerevisiae*.

Embodiment I-6. The genetically modified host cell of Embodiment I-2, wherein the host cell is a plant cell.

Embodiment I-7. The genetically modified host cell of Embodiment I-1, wherein the host cell is a prokaryotic cell.

Embodiment I-8. The genetically modified host cell of Embodiment I-1, wherein the one or more polypeptides that generate hexanoyl-CoA or a hexanoyl-CoA derivative is hexanoyl-CoA synthetase (HCS) polypeptide, and wherein the medium comprises hexanoate.

Embodiment I-9. The genetically modified host cell of Embodiment I-6, wherein the HCS polypeptide comprises an amino acid having at least 50% (at least 50%, at least 60%, at least 70%, at least 75%, at least 80%, at least 85%, at least 90%, at least 95%, at least 98%, at least 99%, or 100%) amino acid sequence identity to the amino acid sequence set forth in SEQ ID NO:1, SEQ ID NO:2, SEQ ID NO:3, or SEQ ID NO:4.

Embodiment I-10. The genetically modified host cell of Embodiment I-1, wherein the one or more polypeptides that generate geranyl pyrophosphate comprise geranyl pyrophosphate synthetase (GPPS) polypeptide.

Embodiment I-11. The genetically modified host cell of Embodiment I-11, wherein the GPPS polypeptide comprises an amino acid having at least 50% (at least 50%, at least 60%, at least 70%, at least 75%, at least 80%, at least 85%, at least 90%, at least 95%, at least 98%, at least 99%, or 100%) amino acid sequence identity to one of the amino acid sequences set forth in SEQ ID NO:5, SEQ ID NO:6, SEQ ID NO:7, or SEQ ID NO:8.

Embodiment I-12. The genetically modified host cell of Embodiment I-10, wherein the GPPS polypeptide is a dominant negative variant that reduces the ability of an endogenous GPPS polypeptide to function as a farnesyl pyrophosphate synthetase (FPPS) polypeptide.

Embodiment I-13. The genetically modified host cell of Embodiment I-10, wherein the GPPS polypeptide comprises a K197G amino acid substitution.

Embodiment I-14. The genetically modified host cell of Embodiment I-10, wherein the GPPS polypeptide is a heterodimeric protein comprising a GPPS large subunit polypeptide and a GPPS small subunit polypeptide, or a homodimeric or monomeric GPPS polypeptide.

Embodiment I-15. The genetically modified host cell of Embodiment I-1, wherein the one or more polypeptides that generate malonyl-CoA comprises acetyl-CoA carboxylase-1 (ACC1) polypeptide.

Embodiment I-16. The genetically modified host cell of Embodiment I-15, wherein the ACC1 polypeptide comprises an amino acid having at least 50% (at least 50%, at least 60%, at least 70%, at least 75%, at least 80%, at least 85%, at least 90%, at least 95%, at least 98%, at least 99%, or 100%) amino acid sequence identity to the amino acid sequence set forth in SEQ ID NO:9.

Embodiment I-17. The genetically modified host cell of Embodiment I-1, wherein the one or more polypeptides that generate hexanoyl-CoA comprise an MCT1 polypeptide, a PaaH1 polypeptide, a Crt polypeptide, a Ter polypeptide, and a BktB polypeptide.

Embodiment I-18. The genetically modified host cell of Embodiment I-1, wherein the one or more polypeptides that generate hexanoyl-CoA comprise a MCT1 polypeptide, a PhaB polypeptide, a PhaJ polypeptide, a Ter polypeptide, and a BktB polypeptide.

Embodiment I-19. The genetically modified host cell of Embodiment I-17, wherein: i) the PaaH1 polypeptide comprises an amino acid having at least 50% (at least 50%, at least 60%, at least 70%, at least 75%, at least 80%, at least 85%, at least 90%, at least 95%, at least 98%, at least 99%, or 100%) amino acid sequence identity to the amino acid sequence set forth in SEQ ID NO:18 or SEQ ID NO:46; ii) the Crt polypeptide comprises an amino acid having at least 50% (at least 50%, at least 60%, at least 70%, at least 75%, at least 80%, at least 85%, at least 90%, at least 95%, at least 98%, at least 99%, or 100%) amino acid sequence identity to the amino acid sequence set forth in SEQ ID NO:19 or SEQ ID NO:48; iii) the Ter polypeptide comprises an amino acid having at least 50% (at least 50%, at least 60%, at least 70%, at least 75%, at least 80%, at least 85%, at least 90%, at least 95%, at least 98%, at least 99%, or 100%) amino acid sequence identity to the amino acid sequence set forth in SEQ ID NO:20 or SEQ ID NO:50; and iv) the BktB polypeptide comprises an amino acid having at least 50% (at least 50%, at least 60%, at least 70%, at least 75%, at least 80%, at least 85%, at least 90%, at least 95%, at least 98%, at least 99%, or 100%) amino acid sequence identity to the amino acid sequence set forth in SEQ ID NO:21 or SEQ ID NO:44.

Embodiment I-20. The genetically modified host cell of Embodiment I-18, wherein: i) the PhaB polypeptide comprises an amino acid having at least 50% (at least 50%, at least 60%, at least 70%, at least 75%, at least 80%, at least 85%, at least 90%, at least 95%, at least 98%, at least 99%, or 100%) amino acid sequence identity to the amino acid sequence set forth in SEQ ID NO:94; ii) the PhaJ polypeptide comprises an amino acid having at least 50% (at least 50%, at least 60%, at least 70%, at least 75%, at least 80%, at least 85%, at least 90%, at least 95%, at least 98%, at least 99%, or 100%) amino acid sequence identity to the amino acid sequence set forth in SEQ ID NO:96; iii) the Ter polypeptide comprises an amino acid having at least 50% (at least 50%, at least 60%, at least 70%, at least 75%, at least 80%, at least 85%, at least 90%, at least 95%, at least 98%, at least 99%, or 100%) amino acid sequence identity to the amino acid sequence set forth in SEQ ID NO:20 or SEQ ID NO:50; and iv) the BktB polypeptide comprises an amino acid having at least 50% (at least 50%, at least 60%, at least 70%, at least 75%, at least 80%, at least 85%, at least 90%, at least 95%, at least 98%, at least 99%, or 100%) amino acid sequence identity to the amino acid sequence set forth in SEQ ID NO:21 or SEQ ID NO:44.

Embodiment I-21. The genetically modified host cell of Embodiment I-1, wherein the host cell is genetically modified with a heterologous nucleic acid encoding one or more polypeptides that modulate NADH redox balance.

Embodiment I-22. The genetically modified host cell of Embodiment I-1, wherein the host cell is genetically modified with one or more of: i) one or more heterologous nucleic acids encoding a HMG-CoA synthase polypeptide; ii) one or more heterologous nucleic acids encoding a 3-hydroxy-3-methyl-glutaryl-CoA reductase (HMGR) polypeptide; iii) one or more heterologous nucleic acids encoding an MK polypeptide; and iv) one or more heterologous nucleic acids encoding an isopentenyl diphosphate isomerase (IDI) polypeptide.

Embodiment I-23. The genetically modified host cell of Embodiment I-22, wherein the host cell is genetically modified to overexpress a heterologous polypeptide.

Embodiment I-24. The genetically modified host cell of Embodiment I-23, wherein the IDI polypeptide comprises an amino acid having at least 50% (at least 50%, at least 60%, at least 70%, at least 75%, at least 80%, at least 85%, at least 90%, at least 95%, at least 98%, at least 99%, or 100%) amino acid sequence identity to the amino acid sequence set forth in SEQ ID NO:58.

Embodiment I-25. The genetically modified host cell of Embodiment I-22, wherein the host cell is genetically modified to overexpress a truncated HMGR (tHMGR) polypeptide.

Embodiment I-26. The genetically modified host cell of Embodiment I-25, wherein the tHMGR polypeptide comprises an amino acid having at least 50% (at least 50%, at least 60%, at least 70%, at least 75%, at least 80%, at least 85%, at least 90%, at least 95%, at least 98%, at least 99%, or 100%) amino acid sequence identity to the amino acid sequence set forth in SEQ ID NO:17.

Embodiment I-27. The genetically modified host cell of Embodiment I-22, wherein the HMGR polypeptide comprises an amino acid having at least 50% (at least 50%, at least 60%, at least 70%, at least 75%, at least 80%, at least 85%, at least 90%, at least 95%, at least 98%, at least 99%, or 100%) amino acid sequence identity to the amino acid sequence set forth in SEQ ID NO:22.

Embodiment I-28. The genetically modified host cell of Embodiment I-22, wherein the HMGS polypeptide comprises an amino acid having at least 50% (at least 50%, at least 60%, at least 70%, at least 75%, at least 80%, at least 85%, at least 90%, at least 95%, at least 98%, at least 99%, or 100%) amino acid sequence identity to the MvaS polypeptide amino acid sequence set forth in SEQ ID NO:23, or wherein the HMGS polypeptide comprises an amino acid having at least 50% amino acid sequence identity to the ERG13 polypeptide amino acid sequence set forth in SEQ ID NO:24.

Embodiment I-29. The genetically modified host cell of Embodiment I-22, wherein the MK polypeptide comprises an amino acid having at least 50% (at least 50%, at least 60%, at least 70%, at least 75%, at least 80%, at least 85%, at least 90%, at least 95%, at least 98%, at least 99%, or 100%) amino acid sequence identity to the ERG12 polypeptide amino acid sequence set forth in SEQ ID NO:64.

Embodiment I-30. The genetically modified host cell of Embodiment I-1, wherein the host cell is genetically modified with a heterologous nucleic acid encoding one or more polypeptides that condense two molecules of acetyl-CoA to generate acetoacetyl-CoA.

Embodiment I-31. The genetically modified host cell of Embodiment I-30, wherein the polypeptide that condenses two molecules of acetyl-CoA to generate acetoacetyl-CoA is an acetoacetyl-CoA thiolase polypeptide.

Embodiment I-32. The genetically modified host cell of Embodiment I-31, wherein the acetoacetyl-CoA thiolase polypeptide comprises an amino acid having at least 50% (at least 50%, at least 60%, at least 70%, at least 75%, at least 80%, at least 85%, at least 90%, at least 95%, at least 98%, at least 99%, or 100%) amino acid sequence identity to the amino acid sequence set forth in SEQ ID NO:25.

Embodiment I-33. The genetically modified host cell of Embodiment I-1, wherein the host cell is genetically modified with a heterologous nucleic acid encoding one or more polypeptides that condense one molecule of acetyl-CoA and one molecule of malonyl-CoA to generate acetoacetyl-CoA.

Embodiment I-34. The genetically modified host cell of any one of Embodiments I-1 to I-33, wherein at least one of the one or more heterologous nucleic acids is integrated into the chromosome of the host cell.

Embodiment I-35. The genetically modified host cell of any one of Embodiments I-1 to I-33, wherein at least one of the one or more heterologous nucleic acids is maintained extrachromosomally.

Embodiment I-36. The genetically modified host cell of any one of Embodiments I-1 to I-33, wherein two or more of the one or more heterologous nucleic acids are present in a single expression vector.

Embodiment I-37. The genetically modified host cell of any one of Embodiments I-1 to I-36, wherein the cannabinoid compound is cannabigerolic acid.

Embodiment I-38. The genetically modified host cell of Embodiment I-1, wherein the genetically modified host cell is genetically modified with a heterologous nucleic acid encoding a $\Delta^9$-THCA synthase polypeptide.

Embodiment I-39. The genetically modified host cell of Embodiment I-38, wherein the THCA synthase polypeptide comprises an amino acid having at least 50% (at least 50%, at least 60%, at least 70%, at least 75%, at least 80%, at least 85%, at least 90%, at least 95%, at least 98%, at least 99%, or 100%) amino acid sequence identity to SEQ ID NO:14 or SEQ ID NO:15.

Embodiment I-40. The genetically modified host cell of Embodiment I-1, wherein the genetically modified host cell is genetically modified with a heterologous nucleic acid encoding a CBDA synthase polypeptide.

Embodiment I-41. The genetically modified host cell of Embodiment I-40, wherein the CBDA synthase polypeptide comprises an amino acid having at least 50% (at least 50%, at least 60%, at least 70%, at least 75%, at least 80%, at least 85%, at least 90%, at least 95%, at least 98%, at least 99%, or 100%) amino acid sequence identity to SEQ ID NO:88 or SEQ ID NO:16.

Embodiment I-42. The genetically modified host cell of any one of Embodiments I-1 to I-41, wherein at least one of the heterologous nucleic acids is operably linked to an inducible promoter.

Embodiment I-43. The genetically modified host cell of any one of Embodiments I-1 to I-41, wherein at least one of the heterologous nucleic acids is operably linked to a constitutive promoter.

Embodiment I-44. The genetically modified host cell of Embodiment I-1, wherein the cannabinoid compound is cannabichromenic acid, cannabigerolic acid, $\Delta^9$-tetrahydrocannabinolic acid, cannabidiolic acid, $\Delta^9$-tetrahydrocannabinol, cannabidiol, or cannabichromene.

Embodiment I-45. A method of synthesizing a cannabinoid compound or cannabinoid precursor in a host cell, the method comprising: a) culturing a host cell of any one of Embodiments I-1 to I-40 in a suitable medium; and b) recovering the produced cannabinoid compound or cannabinoid precursor.

Embodiment I-46. The method of Embodiment I-45, wherein the medium comprises a fermentable sugar.

Embodiment I-47. The method of Embodiment I-45, wherein the medium comprises a pretreated cellulosic feedstock.

Embodiment I-48. A genetically modified host cell that produces an olivetolic acid derivative, wherein the genetically modified host cell is genetically modified with: a) one or more heterologous nucleic acids that encode an acyl-activating enzyme (AAE) polypeptide; and b) one or more heterologous nucleic acids that encode a TKS/OAC fusion polypeptide.

Embodiment I-49. The genetically modified host cell of Embodiment I-48, wherein the AAE polypeptide comprises an amino acid sequence having at least 50% (at least 50%, at least 60%, at least 70%, at least 75%, at least 80%, at least 85%, at least 90%, at least 95%, at least 98%, at least 99%, or 100%) amino acid sequence identity to an AAE amino acid sequence set forth in SEQ ID NO:90 or SEQ ID NO:91.

Embodiment I-50. A genetically modified host cell that produces a cannabinoid derivative, wherein the genetically modified host cell is genetically modified with: a) one or more heterologous nucleic acids that encode an acyl-activating enzyme (AAE) polypeptide; b) one or more heterologous nucleic acids that encode a TKS/OAC fusion polypeptide; and c) one or more heterologous nucleic acids that encode a GOT polypeptide or an NphB polypeptide.

Embodiment I-51. The genetically modified host cell of Embodiment I-50, wherein the genetically modified host cell is genetically modified with a heterologous nucleic acid encoding a THCAS polypeptide.

Embodiment I-52. The genetically modified host cell of Embodiment I-50, wherein the genetically modified host cell is genetically modified with a heterologous nucleic acid encoding a CBDAS polypeptide.

Embodiment I-53. A method of producing an olivetolic acid derivative, the method comprising culturing the genetically modified host cell of Embodiment I-48 or Embodiment I-49 in a culture medium comprising a carboxylic acid.

Embodiment I-54. A method of producing a cannabinoid derivative, the method comprising culturing the genetically modified host cell of any one of Embodiments I-50 to I-52 in a culture medium comprising a carboxylic acid.

Some embodiments of the disclosure are of Embodiment II:

Embodiment II-1. A genetically modified host cell that produces a cannabinoid compound, a cannabinoid derivative, or a cannabinoid precursor, wherein the genetically modified host cell is genetically modified with: a) one or more heterologous nucleic acids that encode one or more polypeptides that generate hexanoyl-CoA or derivatives of hexanoyl-CoA; b) one or more heterologous nucleic acids that encode one or more polypeptides that generate geranyl pyrophosphate; c) one or more heterologous nucleic acids that encode one or more polypeptides that generate malonyl-CoA; d) one or more heterologous nucleic acids that encode a TKS polypeptide and an OAC polypeptide, or a fusion TKS and OAC polypeptide, that converts hexanoyl-CoA or its derivatives and malonyl-CoA to olivetolic acid or derivatives of olivetolic acid; e) one or more heterologous nucleic acids that encode a geranyl pyrophosphate:olivetolic acid geranyltransferase (GOT) polypeptide or an NphB polypeptide; and f) one or more heterologous nucleic acids that encode a cannabinoid synthase polypeptide, wherein culturing of the genetically modified host cell in a suitable medium provides for synthesis of the cannabinoid compound, cannabinoid derivative, or the cannabinoid precursor in a recoverable amount.

Embodiment II-2. The genetically modified host cell of Embodiment II-1, wherein the host cell is a eukaryotic cell.

Embodiment II-3. The genetically modified host cell of Embodiment II-2, wherein the host cell is a yeast cell.

Embodiment II-4. The genetically modified host cell of Embodiment II-3, wherein the host cell is *Saccharomyces cerevisiae*.

Embodiment II-5. The genetically modified host cell of Embodiment II-4, wherein the host cell is a protease-deficient strain of *Saccharomyces cerevisiae*.

Embodiment II-6. The genetically modified host cell of Embodiment II-2, wherein the host cell is a plant cell.

Embodiment II-7. The genetically modified host cell of Embodiment II-1, wherein the host cell is a prokaryotic cell.

Embodiment II-8. The genetically modified host cell of Embodiment II-1, wherein the one or more polypeptides that generate hexanoyl-CoA or a hexanoyl-CoA derivative is a hexanoyl-CoA synthetase (HCS) polypeptide, and wherein the medium comprises hexanoate.

Embodiment II-9. The genetically modified host cell of Embodiment II-8, wherein the HCS polypeptide comprises an amino acid having at least 50% amino acid sequence identity to the amino acid sequence set forth in SEQ ID NO:1, SEQ ID NO:2, SEQ ID NO:3, or SEQ ID NO:4.

Embodiment II-10. The genetically modified host cell of Embodiment II-1, wherein the one or more polypeptides that generate geranyl pyrophosphate comprise a geranyl pyrophosphate synthetase (GPPS) polypeptide.

Embodiment II-11. The genetically modified host cell of Embodiment II-11, wherein the GPPS polypeptide comprises an amino acid having at least 50% amino acid sequence identity to one of the amino acid sequences set forth in SEQ ID NO:5, SEQ ID NO:6, SEQ ID NO:7, or SEQ ID NO:8.

Embodiment II-12. The genetically modified host cell of Embodiment II-10, wherein the GPPS polypeptide is a dominant negative variant that reduces the ability of an endogenous GPPS polypeptide to function as a farnesyl pyrophosphate synthetase (FPPS) polypeptide.

Embodiment II-13. The genetically modified host cell of Embodiment II-10, wherein the GPPS polypeptide comprises a K197G amino acid substitution.

Embodiment II-14. The genetically modified host cell of Embodiment II-10, wherein the GPPS polypeptide is a heterodimeric protein comprising a GPPS large subunit polypeptide and a GPPS small subunit polypeptide, or a homodimeric or monomeric GPPS polypeptide.

Embodiment II-15. The genetically modified host cell of Embodiment II-1, wherein the one or more polypeptides that generate malonyl-CoA comprises an acetyl-CoA carboxylase-1 (ACC1) polypeptide.

Embodiment II-16. The genetically modified host cell of Embodiment II-15, wherein the ACC1 polypeptide comprises an amino acid having at least 50% amino acid sequence identity to the amino acid sequence set forth in SEQ ID NO:9.

Embodiment II-17. The genetically modified host cell of Embodiment II-1, wherein the one or more polypeptides that generate hexanoyl-CoA comprise a MCT1 polypeptide, a PaaH1 polypeptide, a Crt polypeptide, a Ter polypeptide, and a BktB polypeptide.

Embodiment II-18. The genetically modified host cell of Embodiment II-1, wherein the one or more polypeptides that generate hexanoyl-CoA comprise a MCT1 polypeptide, a PhaB polypeptide, a PhaJ polypeptide, a Ter polypeptide, and a BktB polypeptide.

Embodiment II-19 The genetically modified host cell of Embodiment II-17, wherein: i) the PaaH1 polypeptide comprises an amino acid having at least 50% amino acid sequence identity to the amino acid sequence set forth in SEQ ID NO:18 or SEQ ID NO:46; ii) the Crt polypeptide comprises an amino acid having at least 50% amino acid sequence identity to the amino acid sequence set forth in SEQ ID NO:19 or SEQ ID NO:48; iii) the Ter polypeptide comprises an amino acid having at least 50% amino acid sequence identity to the amino acid sequence set forth in SEQ ID NO:20 or SEQ ID NO:50; and iv) the BktB polypeptide comprises an amino acid having at least 50% amino acid sequence identity to the amino acid sequence set forth in SEQ ID NO:21 or SEQ ID NO:44.

Embodiment II-20. The genetically modified host cell of Embodiment II-18, wherein: i) the PhaB polypeptide comprises an amino acid having at least 50% amino acid sequence identity to the amino acid sequence set forth in SEQ ID NO:94; ii) the PhaJ polypeptide comprises an amino acid having at least 50% amino acid sequence identity to the amino acid sequence set forth in SEQ ID NO:96; iii) the Ter polypeptide comprises an amino acid having at least 50% amino acid sequence identity to the amino acid sequence set forth in SEQ ID NO:20 or SEQ ID NO:50; and iv) the BktB polypeptide comprises an amino acid having at least 50% amino acid sequence identity to the amino acid sequence set forth in SEQ ID NO:21 or SEQ ID NO:44.

Embodiment II-21. The genetically modified host cell of Embodiment II-1, wherein the host cell is genetically modified with a heterologous nucleic acid encoding one or more polypeptides that modulate NADH redox balance.

Embodiment II-22. The genetically modified host cell of Embodiment II-1, wherein the host cell is genetically modified with one or more of: i) one or more heterologous nucleic acids that encode an HMG-CoA synthase polypeptide; ii) one or more heterologous nucleic acids that encode a 3-hydroxy-3-methyl-glutaryl-CoA reductase (HMGR) polypeptide; iii) one or more heterologous nucleic acids that encode an MK polypeptide; and iv) one or more heterologous nucleic acids that encode an isopentenyl diphosphate isomerase (IDI) polypeptide.

Embodiment II-23. The genetically modified host cell of Embodiment II-22, wherein the host cell is genetically modified to overexpress a heterologous IDI polypeptide.

Embodiment II-24. The genetically modified host cell of Embodiment II-23, wherein the IDI polypeptide comprises an amino acid having at least 50% amino acid sequence identity to the amino acid sequence set forth in SEQ ID NO:58.

Embodiment II-25. The genetically modified host cell of Embodiment II-22, wherein the host cell is genetically modified to overexpress a truncated HMGR (tHMGR) polypeptide.

Embodiment II-26. The genetically modified host cell of Embodiment II-25, wherein the tHMGR polypeptide comprises an amino acid having at least 50% amino acid sequence identity to the amino acid sequence set forth in SEQ ID NO:17.

Embodiment II-27. The genetically modified host cell of Embodiment II-22, wherein the HMGR polypeptide comprises an amino acid having at least 50% amino acid sequence identity to the amino acid sequence set forth in SEQ ID NO:22.

Embodiment II-28. The genetically modified host cell of Embodiment II-22, wherein the HMGS polypeptide comprises an amino acid having at least 50% amino acid sequence identity to the MvaS polypeptide amino acid sequence set forth in SEQ ID NO:23, or wherein the HMGS polypeptide comprises an amino acid having at least 50% amino acid sequence identity to the ERG13 polypeptide amino acid sequence set forth in SEQ ID NO:24.

Embodiment II-29. The genetically modified host cell of Embodiment II-22, wherein the MK polypeptide comprises an amino acid having at least 50% amino acid sequence identity to the ERG12 polypeptide amino acid sequence set forth in SEQ ID NO:64.

Embodiment II-30. The genetically modified host cell of Embodiment II-1, wherein the host cell is genetically modified with a heterologous nucleic acid encoding one or more polypeptides that condense two molecules of acetyl-CoA to generate acetoacetyl-CoA.

Embodiment II-31. The genetically modified host cell of Embodiment II-30, wherein the polypeptide that condenses two molecules of acetyl-CoA to generate acetoacetyl-CoA is an acetoacetyl-CoA thiolase polypeptide.

Embodiment II-32. The genetically modified host cell of Embodiment II-31, wherein the acetoacetyl-CoA thiolase polypeptide comprises an amino acid sequence having at least 50% sequence identity to SEQ ID NO:25.

Embodiment II-33. The genetically modified host cell of Embodiment II-1, wherein the host cell is genetically modified with a heterologous nucleic acid encoding one or more polypeptides that condense one molecule of acetyl-CoA and one molecule of malonyl-CoA to generate acetoacetyl-CoA.

Embodiment II-34. The genetically modified host cell of any one of Embodiments II-1 to II-33, wherein at least one of the one or more heterologous nucleic acids is integrated into the chromosome of the host cell.

Embodiment II-35. The genetically modified host cell of any one of Embodiments II-1 to II-33, wherein at least one of the one or more heterologous nucleic acids is maintained extrachromosomally.

Embodiment II-36. The genetically modified host cell of any one of Embodiments II-1 to II-33, wherein two or more of the one or more heterologous nucleic acids are present in a single expression vector.

Embodiment II-37. The genetically modified host cell of any one of Embodiments II-1 to II-36, wherein the cannabinoid compound is cannabigerolic acid.

Embodiment II-38. The genetically modified host cell of Embodiment II-1, wherein the genetically modified host cell is genetically modified with a heterologous nucleic acid encoding a $\Delta^9$-THCA synthase polypeptide.

Embodiment II-39. The genetically modified host cell of Embodiment II-38, wherein the THCA synthase polypeptide comprises an amino acid having at least 50% amino acid sequence identity to SEQ ID NO:14 or SEQ ID NO:15.

Embodiment II-40. The genetically modified host cell of Embodiment II-1, wherein the genetically modified host cell is genetically modified with a heterologous nucleic acid encoding a CBDA synthase polypeptide.

Embodiment II-41. The genetically modified host cell of Embodiment II-40, wherein the CBDA synthase polypeptide, comprises an amino acid having at least 50% amino acid sequence identity to SEQ ID NO:88 or SEQ ID NO:16.

Embodiment II-42. The genetically modified host cell of any one of Embodiments II-1 to II-41, wherein at least one of the heterologous nucleic acids is operably linked to an inducible promoter.

Embodiment II-43. The genetically modified host cell of any one of Embodiments II-1 to II-41, wherein at least one of the heterologous nucleic acids is operably linked to a constitutive promoter.

Embodiment II-44. The genetically modified host cell of Embodiment II-1, wherein the cannabinoid compound is cannabichromenic acid, cannabigerolic acid, $\Delta^9$-tetrahydrocannabinolic acid, cannabidiolic acid, $\Delta^9$-tetrahydrocannabinol, cannabidiol, or cannabichromene.

Embodiment II-45. A method of synthesizing a cannabinoid compound or cannabinoid precursor in a host cell, the method comprising: a) culturing a host cell of any one of Embodiments II-1 to II-40 in a suitable medium; and b) recovering the produced cannabinoid compound or cannabinoid precursor.

Embodiment II-46. The method of Embodiment II-45, wherein the medium comprises a fermentable sugar.

Embodiment II-47. The method of Embodiment II-45, wherein the medium comprises a pretreated cellulosic feedstock.

Embodiment II-48. A genetically modified host cell that produces an olivetolic acid derivative, wherein the genetically modified host cell is genetically modified with: a) one or more heterologous nucleic acids that encode an acyl-activating enzyme (AAE) polypeptide; and b) one or more heterologous nucleic acids that encode a TKS/OAC fusion polypeptide.

Embodiment II-49. The genetically modified host cell of Embodiment II-48, wherein the AAE polypeptide comprises an amino acid sequence having at least 50% amino acid sequence identity to an AAE amino acid sequence set forth in SEQ ID NO:90 or SEQ ID NO:91.

Embodiment II-50. A genetically modified host cell that produces a cannabinoid derivative, wherein the genetically modified host cell is genetically modified with: a) one or more heterologous nucleic acids that encode an acyl-activating enzyme (AAE) polypeptide; b) one or more heterologous nucleic acids that encode a TKS/OAC fusion polypeptide; and c) one or more heterologous nucleic acids that encode a GOT polypeptide or an NphB polypeptide.

Embodiment II-51. The genetically modified host cell of Embodiment II-50, wherein the genetically modified host cell is genetically modified with a heterologous nucleic acid encoding a THCAS polypeptide.

Embodiment II-52. The genetically modified host cell of Embodiment II-50, wherein the genetically modified host cell is genetically modified with a heterologous nucleic acid encoding a CBDAS polypeptide.

Embodiment II-53. A method of producing an olivetolic acid derivative, the method comprising culturing the genetically modified host cell of Embodiment II-48 or II-49 in a culture medium comprising a carboxylic acid.

Embodiment II-54. A method of producing a cannabinoid derivative, the method comprising culturing the genetically modified host cell of any one of Embodiments II-50 to II-52 in a culture medium comprising a carboxylic acid.

Embodiment II-55. The genetically modified host cell of Embodiment II-1, wherein the geranyl pyrophosphate olivetolic acid geranyltransferase (GOT) polypeptide or the NphB polypeptide comprises an amino acid having at least 50% amino acid sequence identity to the amino acid sequence of a GOT polypeptide, including CsPT4t polypeptide, or NphB polypeptide sequence, respectively, disclosed herein.

Some embodiments of the disclosure are of Embodiment III:

Embodiment III-1. A genetically modified host cell for producing a cannabinoid or a cannabinoid derivative, the genetically modified host cell comprising one or more heterologous nucleic acids encoding a geranyl pyrophosphate:olivetolic acid geranyltransferase polypeptide, wherein said geranyl pyrophosphate:olivetolic acid geranyltransferase polypeptide can catalyze production of cannabigerolic acid from geranyl pyrophosphate and olivetolic acid in an amount at least ten times higher than a polypeptide comprising an amino acid sequence set forth in SEQ ID NO:82.

Embodiment III-2. A genetically modified host cell for producing a cannabinoid or a cannabinoid derivative, the genetically modified host cell comprising one or more heterologous nucleic acids encoding a geranyl pyrophosphate:olivetolic acid geranyltransferase polypeptide comprising an amino acid sequence having at least 65% sequence identity to SEQ ID NO:110.

Embodiment III-3. A genetically modified host cell for producing a cannabinoid or a cannabinoid derivative, the genetically modified host cell comprising one or more heterologous nucleic acids encoding a geranyl pyrophosphate:olivetolic acid geranyltransferase polypeptide comprising an amino acid sequence having at least 65% sequence identity to SEQ ID NO:100.

Embodiment III-4. The genetically modified host cell of any one of Embodiments III-1 to III-3, wherein the genetically modified host cell further comprises one or more heterologous nucleic acids encoding a tetraketide synthase (TKS) polypeptide and one or more heterologous nucleic acids encoding an olivetolic acid cyclase (OAC) polypeptide, or one or more heterologous nucleic acids encoding a fusion TKS and OAC polypeptide.

Embodiment III-5. The genetically modified host cell of Embodiment III-4, wherein the TKS polypeptide comprises an amino acid sequence having at least 50% sequence identity to SEQ ID NO:11 or SEQ ID NO:76.

Embodiment III-6. The genetically modified host cell of Embodiment III-4 or III-5, wherein the OAC polypeptide comprises an amino acid sequence having at least 50% sequence identity to SEQ ID NO:10 or SEQ ID NO:78.

Embodiment III-7. The genetically modified host cell of any one of Embodiments III-1 to III-6, wherein the genetically modified host cell further comprises one or more of the following: a) one or more heterologous nucleic acids encoding a polypeptide that generates an acyl-CoA compound or an acyl-CoA compound derivative; b) one or more heterologous nucleic acids encoding a polypeptide that generates geranyl pyrophosphate; or c) one or more heterologous nucleic acids encoding a polypeptide that generates malonyl-CoA.

Embodiment III-8. The genetically modified host cell of Embodiment III-7, wherein the genetically modified host cell further comprises one or more heterologous nucleic acids encoding a polypeptide that generates an acyl-CoA compound or an acyl-CoA compound derivative, wherein the polypeptide that generates an acyl-CoA compound or an acyl-CoA compound derivative is an acyl-activating enzyme (AAE) polypeptide.

Embodiment III-9. The genetically modified host cell of Embodiment III-8, wherein the AAE polypeptide comprises an amino acid sequence having at least 50% sequence identity to SEQ ID NO:90.

Embodiment III-10. The genetically modified host cell of Embodiment III-8, wherein the AAE polypeptide comprises an amino acid sequence having at least 50% sequence identity to SEQ ID NO:92 or SEQ ID NO:149.

Embodiment III-11. The genetically modified host cell of Embodiment III-7, wherein the genetically modified host cell further comprises one or more heterologous nucleic acids encoding a polypeptide that generates an acyl-CoA compound or an acyl-CoA compound derivative, wherein the polypeptide that generates an acyl-CoA compound or an acyl-CoA compound derivative is a fatty acyl-CoA ligase polypeptide.

Embodiment III-12. The genetically modified host cell of Embodiment III-11, wherein the fatty acyl-CoA ligase polypeptide comprises an amino acid sequence having at least 50% sequence identity to SEQ ID NO:145 or SEQ ID NO:147.

Embodiment III-13. The genetically modified host cell of Embodiment III-7, wherein the genetically modified host cell further comprises one or more heterologous nucleic acids encoding a polypeptide that generates an acyl-CoA compound or an acyl-CoA compound derivative, wherein the polypeptide that generates an acyl-CoA compound or an acyl-CoA compound derivative is a fatty acyl-CoA synthetase (FAA) polypeptide.

Embodiment III-14. The genetically modified host cell of Embodiment III-13, wherein the FAA polypeptide comprises an amino acid sequence having at least 50% sequence identity to SEQ ID NO:169, SEQ ID NO:192, SEQ ID NO:194, SEQ ID NO:196, SEQ ID NO:198, or SEQ ID NO:200.

Embodiment III-15. The genetically modified host cell of any one of Embodiments III-7 to III-14, wherein the genetically modified host cell further comprises one or more heterologous nucleic acids encoding a polypeptide that generates geranyl pyrophosphate, wherein the polypeptide that generates geranyl pyrophosphate is a geranyl pyrophosphate synthetase (GPPS) polypeptide.

Embodiment III-16. The genetically modified host cell of Embodiment III-15, wherein the GPPS polypeptide comprises an amino acid sequence having at least 50% sequence identity to SEQ ID NO:7, SEQ ID NO:8, or SEQ ID NO:60.

Embodiment III-17. The genetically modified host cell of any one of Embodiments III-7 to III-16, wherein the genetically modified host cell further comprises one or more heterologous nucleic acids encoding a polypeptide that generates malonyl-CoA, wherein the polypeptide that generates malonyl-CoA is an acetyl-CoA carboxylase-1 (ACC1) polypeptide.

Embodiment III-18. The genetically modified host cell of Embodiment III-17, wherein the ACC1 polypeptide comprises an amino acid sequence having at least 50% sequence identity to SEQ ID NO:9, SEQ ID NO:97, or SEQ ID NO:207.

Embodiment III-19. The genetically modified host cell of any one of Embodiments III-1 to III-18, wherein the genetically modified host cell further comprises one or more of the following: a) one or more heterologous nucleic acids encoding a HMG-CoA synthase (HMGS) polypeptide; b) one or more heterologous nucleic acids encoding a 3-hydroxy-3-methyl-glutaryl-CoA reductase (HMGR) polypeptide; c) one or more heterologous nucleic acids encoding a mevalonate kinase (MK) polypeptide; d) one or more heterologous nucleic acids encoding a phosphomevalonate kinase (PMK) polypeptide; e) one or more heterologous nucleic acids encoding a mevalonate pyrophosphate decarboxylase (MVD) polypeptide; or f) one or more heterologous nucleic acids encoding a isopentenyl diphosphate isomerase (IDI) polypeptide.

Embodiment III-20. The genetically modified host cell of Embodiment III-19, wherein the genetically modified host cell further comprises one or more heterologous nucleic acids encoding an IDI polypeptide.

Embodiment III-21. The genetically modified host cell of Embodiment III-20, wherein the IDI polypeptide comprises an amino acid sequence having at least 50% sequence identity to SEQ ID NO:58.

Embodiment III-22. The genetically modified host cell of any one of Embodiments III-19 to III-21, wherein the genetically modified host cell further comprises one or more heterologous nucleic acids encoding an HMGR polypeptide.

Embodiment III-23. The genetically modified host cell of Embodiment III-22, wherein the HMGR polypeptide comprises an amino acid sequence having at least 50% sequence identity to SEQ ID NO:22.

Embodiment III-24. The genetically modified host cell of any one of Embodiments III-19 to III-21, wherein the genetically modified host cell further comprises one or more heterologous nucleic acids encoding an HMGR polypeptide, wherein the HMGR polypeptide is a truncated HMGR (tHMGR) polypeptide.

Embodiment III-25. The genetically modified host cell of Embodiment III-24, wherein the tHMGR polypeptide comprises an amino acid sequence having at least 50% sequence identity to SEQ ID NO:17, SEQ ID NO:52, SEQ ID NO:113, or SEQ ID NO:208.

Embodiment III-26. The genetically modified host cell of any one of Embodiments III-19 to III-25, wherein the genetically modified host cell further comprises one or more heterologous nucleic acids encoding an HMGS polypeptide.

Embodiment III-27. The genetically modified host cell of Embodiment III-26, wherein the HMGS polypeptide comprises an amino acid sequence having at least 50% sequence identity to SEQ ID NO:23, SEQ ID NO:24, or SEQ ID NO:115.

Embodiment III-28. The genetically modified host cell of any one of Embodiments III-19 to III-27, wherein the genetically modified host cell further comprises one or more heterologous nucleic acids encoding an MK polypeptide.

Embodiment The genetically modified host cell of Embodiment III-28, wherein the MK polypeptide comprises an amino acid sequence having at least 50% sequence identity to SEQ ID NO:64.

Embodiment III-30. The genetically modified host cell of any one of Embodiments III-19 to III-29, wherein the genetically modified host cell further comprises one or more heterologous nucleic acids encoding a PMK polypeptide.

Embodiment III-31. The genetically modified host cell of Embodiment III-30, wherein the PMK polypeptide comprises an amino acid sequence having at least 50% sequence identity to SEQ ID NO:62 or SEQ ID NO:205.

Embodiment III-32. The genetically modified host cell of any one of Embodiments III-19 to III-31, wherein the genetically modified host cell further comprises one or more heterologous nucleic acids encoding a MVD polypeptide.

Embodiment III-33. The genetically modified host cell of Embodiment III-32, wherein the MVD polypeptide comprises an amino acid sequence having at least 50% sequence identity to SEQ ID NO:66.

Embodiment III-34. The genetically modified host cell of any one of Embodiments III-1 to III-33, wherein the genetically modified host cell further comprises one or more heterologous nucleic acids encoding a polypeptide that condenses two molecules of acetyl-CoA to generate acetoacetyl-CoA.

Embodiment III-35. The genetically modified host cell of Embodiment III-34, wherein the polypeptide that condenses two molecules of acetyl-CoA to generate acetoacetyl-CoA is an acetoacetyl-CoA thiolase polypeptide.

Embodiment III-36. The genetically modified host cell of Embodiment III-35, wherein the acetoacetyl-CoA thiolase polypeptide comprises an amino acid sequence having at least 50% sequence identity to SEQ ID NO:25.

Embodiment III-37. The genetically modified host cell of any one of Embodiments III-1 to III-36, wherein the genetically modified host cell further comprises one or more heterologous nucleic acids encoding a pyruvate decarboxylase (PDC) polypeptide.

Embodiment III-38. The genetically modified host cell of Embodiment III-37, wherein the PDC polypeptide comprises an amino acid sequence having at least 50% sequence identity to SEQ ID NO:117.

Embodiment III-39. The genetically modified host cell of any one of Embodiments III-1 to III-38, wherein the genetically modified host cell is a eukaryotic cell.

Embodiment III-40. The genetically modified host cell of Embodiment III-39, wherein the eukaryotic cell is a yeast cell.

Embodiment III-41. The genetically modified host cell of Embodiment III-40, wherein the yeast cell is *Saccharomyces cerevisiae*.

Embodiment III-42. The genetically modified host cell of Embodiment III-41, wherein the *Saccharomyces cerevisiae* is a protease-deficient strain of *Saccharomyces cerevisiae*.

Embodiment III-43. The genetically modified host cell of any one of Embodiments III-1 to III-39, wherein the genetically modified host cell is a plant cell.

Embodiment III-44. The genetically modified host cell of any one of Embodiments III-1 to III-38, wherein the genetically modified host cell is a prokaryotic cell.

Embodiment III-45. The genetically modified host cell of any one of Embodiments III-1 to III-44, wherein at least one of the one or more heterologous nucleic acids is integrated into the chromosome of the genetically modified host cell.

Embodiment III-46. The genetically modified host cell of any one of Embodiments III-1 to III-44, wherein at least one of the one or more heterologous nucleic acids is maintained extrachromosomally.

Embodiment III-47. The genetically modified host cell of any one of Embodiments III-1 to III-44, wherein two or more of the one or more heterologous nucleic acids are present in a single expression vector.

Embodiment III-48. The genetically modified host cell of any one of Embodiments III-1 to III-44, wherein at least one of the heterologous nucleic acids is operably linked to an inducible promoter.

Embodiment III-49. The genetically modified host cell of any one of Embodiments III-1 to III-44, wherein at least one of the heterologous nucleic acids is operably linked to a constitutive promoter.

Embodiment III-50. The genetically modified host cell of any one of Embodiments III-1 to III-49, wherein culturing of the genetically modified host cell in a suitable medium provides for synthesis of the cannabinoid or the cannabinoid derivative in an increased amount compared to a non-genetically modified host cell cultured under similar conditions.

Embodiment III-51. The genetically modified host cell of any one of Embodiments III-1 to III-50, wherein the genetically modified host cell further comprises one or more heterologous nucleic acids encoding a cannabinoid synthase polypeptide.

Embodiment III-52. The genetically modified host cell of Embodiment III-51, wherein the cannabinoid synthase polypeptide is a tetrahydrocannabinolic acid (THCA) synthase polypeptide.

Embodiment III-53. The genetically modified host cell of Embodiment III-52, wherein the THCA synthase polypeptide comprises an amino acid sequence having at least 50% sequence identity to SEQ ID NO:14, SEQ ID NO:86, SEQ ID NO:104, SEQ ID NO:153, or SEQ ID NO:155.

Embodiment III-54. The genetically modified host cell of Embodiment III-51, wherein the cannabinoid synthase polypeptide is a cannabidiolic acid (CBDA) synthase polypeptide.

Embodiment III-55. The genetically modified host cell of Embodiment III-54, wherein the CBDA synthase polypeptide comprises an amino acid sequence having at least 50% sequence identity to SEQ ID NO:88 or SEQ ID NO:151.

Embodiment III-56. The genetically modified host cell of any one of Embodiments III-1 to III-55, wherein the cannabinoid is cannabigerolic acid, cannabigerol, $\Delta^9$-tetrahydrocannabinolic acid, $\Delta^9$-tetrahydrocannabinol, $\Delta^8$-tetrahydrocannabinolic acid, $\Delta^8$-tetrahydrocannabinol, cannabidiolic acid, cannabidiol, cannabichromenic acid, cannabichromene, cannabinolic acid, cannabinol, cannabidivarinic acid, cannabidivarin, tetrahydrocannabivarinic acid, tetrahydrocannabivarin, cannabichromevarinic acid, cannabichromevarin, cannabigerovarinic acid, cannabigerovarin, cannabicyclolic acid, cannabicyclol, cannabielsoinic acid, cannabielsoin, cannabicitranic acid, or cannabicitran.

Embodiment III-57. The genetically modified host cell of Embodiment III-56, wherein the cannabinoid is cannabigerolic acid.

Embodiment III-58. A method of producing a cannabinoid or a cannabinoid derivative in a genetically modified host cell, the method comprising: a) culturing the genetically modified host cell of any one of Embodiments III-1 to III-57 in a suitable medium; and b) recovering the produced cannabinoid or cannabinoid derivative.

Embodiment III-59. A method of producing a cannabinoid or a cannabinoid derivative, the method comprising: a) culturing the genetically modified host cell of any one of Embodiments III-1 to III-57 in a suitable medium comprising a carboxylic acid; b) recovering the produced cannabinoid or cannabinoid derivative.

Embodiment III-60. A method of producing a cannabinoid or a cannabinoid derivative, the method comprising: a) culturing the genetically modified host cell of any one of Embodiments III-1 to III-57 in a suitable medium comprising olivetolic acid or an olivetolic acid derivative; b) recovering the produced cannabinoid or cannabinoid derivative.

Embodiment III-61. A method of producing a cannabinoid or a cannabinoid derivative in a genetically modified host cell, the method comprising: a) culturing a genetically modified host cell comprising one or more heterologous nucleic acids encoding a geranyl pyrophosphate:olivetolic acid geranyltransferase polypeptide, wherein said geranyl pyrophosphate:olivetolic acid geranyltransferase polypeptide can catalyze production of cannabigerolic acid from geranyl pyrophosphate and olivetolic acid in an amount at least ten times higher than a polypeptide comprising an amino acid sequence set forth in SEQ ID NO:82, in a suitable medium; and b) recovering the produced cannabinoid or cannabinoid derivative.

Embodiment III-62. A method of producing a cannabinoid or a cannabinoid derivative in a genetically modified host cell, the method comprising: a) culturing a genetically modified host cell comprising one or more heterologous nucleic acids encoding a geranyl pyrophosphate:olivetolic acid geranyltransferase polypeptide comprising an amino acid sequence having at least 65% sequence identity to SEQ ID NO:110 in a suitable medium; and b) recovering the produced cannabinoid or cannabinoid derivative.

Embodiment III-63. A method of producing a cannabinoid or a cannabinoid derivative in a genetically modified host cell, the method comprising: a) culturing a genetically modified host cell comprising one or more heterologous nucleic acids encoding a geranyl pyrophosphate:olivetolic acid geranyltransferase polypeptide comprising an amino acid sequence having at least 65% sequence identity to SEQ ID NO:100 in a suitable medium; and b) recovering the produced cannabinoid or cannabinoid derivative.

Embodiment III-64. The method of any one of Embodiments III-58 to III-63, wherein the suitable medium comprises a fermentable sugar.

Embodiment III-65. The method of any one of Embodiments III-58 to III-63, wherein the suitable medium comprises a pretreated cellulosic feedstock.

Embodiment III-66. The method of any one of Embodiments III-58 to III-63, wherein the suitable medium comprises a non-fermentable carbon source.

Embodiment III-67. The method of Embodiment III-66, wherein the non-fermentable carbon source comprises ethanol.

Embodiment III-68. The method of any one of Embodiments III-58 to III-67, wherein the cannabinoid is cannabigerolic acid, cannabigerol, $\Delta^9$-tetrahydrocannabinolic acid, $\Delta^9$-tetrahydrocannabinol, $\Delta^8$-tetrahydrocannabinolic acid, $\Delta^8$-tetrahydrocannabinol, cannabidiolic acid, cannabidiol, cannabichromenic acid, cannabichromene, cannabinolic acid, cannabinol, cannabidivarinic acid, cannabidivarin, tetrahydrocannabivarinic acid, tetrahydrocannabivarin, cannabichromevarinic acid, cannabichromevarin, cannabigerovarinic acid, cannabigerovarin, cannabicyclolic acid, cannabicyclol, cannabielsoinic acid, cannabielsoin, cannabicitranic acid, or cannabicitran.

Embodiment III-69. An isolated or purified geranyl pyrophosphate:olivetolic acid geranyltransferase polypeptide, wherein said geranyl pyrophosphate:olivetolic acid geranyltransferase polypeptide can catalyze production of cannabigerolic acid from geranyl pyrophosphate and olivetolic acid in an amount at least ten times higher than a polypeptide comprising an amino acid sequence set forth in SEQ ID NO:82.

Embodiment III-70. An isolated or purified polypeptide comprising an amino acid sequence having at least 65% sequence identity to SEQ ID NO:110.

Embodiment III-71. An isolated or purified polypeptide comprising an amino acid sequence having at least 65% sequence identity to SEQ ID NO:100.

Embodiment III-72. An isolated or purified nucleic acid encoding a geranyl pyrophosphate:olivetolic acid geranyltransferase polypeptide, wherein said geranyl pyrophosphate:olivetolic acid geranyltransferase polypeptide can catalyze production of cannabigerolic acid from geranyl pyrophosphate and olivetolic acid in an amount at least ten times higher than a polypeptide comprising an amino acid sequence set forth in SEQ ID NO:82.

Embodiment III-73. An isolated or purified nucleic acid encoding a polypeptide comprising an amino acid sequence having at least 65% sequence identity to SEQ ID NO:110.

Embodiment III-74. An isolated or purified nucleic acid encoding a polypeptide comprising an amino acid sequence having at least 65% sequence identity to SEQ ID NO:100.

Embodiment III-75. A vector comprising a nucleic acid encoding a geranyl pyrophosphate:olivetolic acid geranyltransferase polypeptide, wherein said geranyl pyrophosphate:olivetolic acid geranyltransferase polypeptide can catalyze production of cannabigerolic acid from geranyl pyrophosphate and olivetolic acid in an amount at least ten times higher than a polypeptide comprising an amino acid sequence set forth in SEQ ID NO:82.

Embodiment III-76. A vector comprising a nucleic acid encoding a polypeptide comprising an amino acid sequence having at least 65% sequence identity to SEQ ID NO:110.

Embodiment III-77. A vector comprising a nucleic acid encoding a polypeptide comprising an amino acid sequence having at least 65% sequence identity to SEQ ID NO:100.

Embodiment III-78. A method of making a genetically modified host cell for producing a cannabinoid or a cannabinoid derivative, comprising introducing one or more heterologous nucleic acids encoding a geranyl pyrophosphate:olivetolic acid geranyltransferase polypeptide, wherein said geranyl pyrophosphate:olivetolic acid geranyltransferase polypeptide can catalyze production of cannabigerolic acid from geranyl pyrophosphate and olivetolic acid in an amount at least ten times higher than a polypeptide comprising an amino acid sequence set forth in SEQ ID NO:82, into a host cell.

Embodiment III-79. A method of making a genetically modified host cell for producing a cannabinoid or a cannabinoid derivative, comprising introducing one or more heterologous nucleic acids encoding a geranyl pyrophosphate:olivetolic acid geranyltransferase polypeptide comprising an amino acid sequence having at least 65% sequence identity to SEQ ID NO:110 into a host cell.

Embodiment III-80. A method of making a genetically modified host cell for producing a cannabinoid or a cannabinoid derivative, comprising introducing one or more heterologous nucleic acids encoding a geranyl pyrophosphate:olivetolic acid geranyltransferase polypeptide comprising an amino acid sequence having at least 65% sequence identity to SEQ ID NO:100 into a host cell.

Embodiment III-81. A method of making a genetically modified host cell for producing a cannabinoid or a cannabinoid derivative, comprising introducing the vector of any one of Embodiments III-75 to III-77 into a host cell.

Provided in Table 1 are amino acid and nucleotide sequences disclosed herein. Where a genus and/or species is noted, the sequence should not be construed to be limited only to the specified genus and/or species, but also includes other genera and/or species expressing said sequence.

TABLE 1

Amino acid and nucleotide sequences of the disclosure

| SEQ ID | SEQUENCE |
|---|---|
| SEQ ID NO: 1<br>hexanoyl-CoA<br>synthetase (HCS)<br>GenBank AFD33359<br>*Cannabis saliva* | MALELPHLLPYKLVKGQTLVAQAARAELASSSSSSVILKSNFINNNYIN<br>YCNNNNNNERRLVVRRDWETMASSPSHSRNNNDIRTINHLRHVDSMA<br>TMPSGAGKIPRLNAVILGEALATEENDLVFPTDEFSQQAHVPSPQKYLE<br>MYKRSIEDPAGFWSEIASQFYWKQKWDDSVYSENLDVSKGRVNIEWF<br>KGGITNICYNCLDKNVEAGLGDKIALYWEGNDTGFDDSLTYSQLLHK<br>VCQLANYLKDMGVQKGDAVVIYLPMLLELPITMLACARIGAVHSVVF<br>AGFSAESLSQRIIDCKPKVVITCNAVKRGPKIIHLKDIVDAALVESAKTG<br>VPIDTCLVYENQLAMKRDITKWQDGRDIWWQDVIPKYPTECAVEWV<br>DAEDPLFLLYTSGSTGKPKGVLHTTGGYMVYTATTFKYAFDYKPSDV<br>YWCTADCGWITGHSYVTYGPLLNGASCIVFEGAPNYPDSGRCWDIVD<br>KYKVTIFYTAPTLVRSLMRDGDEYVTRYSRKSLRILGSVGEPINPSAWR<br>WFYNVVGDSRCPISDTWWQTETGGFMITPLPGAWPQKPGSATFPFFGV<br>KPVIVDEKGVEIEGECSGYLCVKGSWPGAFRTLYGDYERYETTYFKPF<br>TGYYFTGDGCSRDKDGYHWLTGRVDDVINVSGHRIGTAEVESALVSH |

TABLE 1-continued

Amino acid and nucleotide sequences of the disclosure

| SEQ ID | SEQUENCE |
|---|---|
| | PKCAEAAVVGIEHEVKGQAIYAFVTLVEGEPYSEELRKSLILSVRKQIG<br>AFAAPERIHWAPGLPKTRSGKIMRRILRKIASGQLDELGDTSTLADPNV<br>VEQLISLSNC |
| SEQ ID NO: 2<br>RcvS<br>BAK64635.1\|<br>putative CoA ligase<br>[Streptomyces sp.<br>SN-593] | MELALPAELAPTLPEALRLRSEQQPDTVAYVFLRDGETPEETLTYGRL<br>DRAARARAAALEAAGLAGGTAVLLYPSGLEFVAALLGCMYAGTAGA<br>PVQVPTRRRGMERARRIADDAGAKTILTTTAVKREVEEHFADLLTGLT<br>VIDTESLPDVPDDAPAVRLPGPDDVALLQYTSGSTGDPKGVEVTHANF<br>RANVAETVELWPVRSDGTVVNWLPLFHDMGLMFGVVMPLFTGVPAY<br>LMAPQSFTRRPARWLEAISRFRGTHAAAPSFAYELCVRSVADTGLPAG<br>LDLSSWRVAVNGAEPVRWTAVADFTEAYAPAGFRPQAMCPGYGLAE<br>NTLKLSGSPEDRPPTLLRADAAALQDGRVVPLTGPGTDGVRLVGSGVT<br>VPSSRVAVVDPGTGTEQPAGRVGEIWINGPCVARGYHGRPAESAESFG<br>ARIAGQEARGTWLRTGDLGFLHDGEVFVAGRLKDVVIHQGRNFYPQD<br>IELSAEVSDRALHPNCAAAFALDDGRTERLVLLVEADGRALRNGGAD<br>ALRARVHDAVWDRQRLRIDEIVLLRRGALPKTSSGKVQRRLARSRYL<br>DGEFGPAPAREA |
| SEQ ID NO: 3<br>hexanoyl-CoA<br>synthase (AflA);<br>GenBank AAL99898<br>Aspergillus sp. | MVIQGKRLAASSIQLLASSLDAKKLCYEYDERQAPGVTQITEEAPTEQP<br>PLSTPPSLPQTPNISPISASKIVIDDVALSRVQIVQALVARKLKTAIAQLP<br>TSKSIKELSGGRSSLQNELVGDIHNEFSSIPDAPEQILLRDFGDANPTVQ<br>LGKTSSAAVAKLISSKMPSDFNANAIRAHLANKWGLGPLRQTAVLLY<br>AIASEPPSRLASSSAAEEYWDNVSSMYAESCGITLRPRQDTMNEDAMA<br>SSAIDPAVVAEFSKGHRRLGVQQFQALAEYLQIDLSGSQASQSDALVA<br>ELQQKVDLWTAEMTPEFLAGISPMLDVKKSRRYGSWWNMARQDVLA<br>FYRRPSYSEFVDDALAFKVFLNRLCNRADEALLNMVRSLSCDAYFKQ<br>GSLPGYHAASRLLEQAITSTVADCPKARLILPAVGPHTTITKDGTIEYAE<br>APRQGVSGPTAYIQSLRQGASFIGLKSADVDTQSNLTDALLDAMCLAL<br>HNGISFVGKTFLVTGAGQGSIGAGVVRLLLEGGARVLVTTSREPATTS<br>RYFQQMYDNHGAKFSELRVVPCNLASAQDCEGLIRHVYDPRGLNWD<br>LDAILPFAAASDYSTEMHDIRGQSELGHRLMLVNVFRVLGHIVHCKRD<br>AGVDCHPTQVLLPLSPNHGIFGGDGMYPESKLALESLFHRIRSESWSDQ<br>LSICGVRIGWTRSTGLMTAHDIIAETVEEHGIRTFSVAEMALNIAMLLT<br>PDFVAHCEDGPLDADFTGSLGTLGSIPGFLAQLHQKVQLAAEVIRAVQ<br>AEDEHERFLSPG1TKPTLQAPVAPMHPRSSLRVG1YPRLPDYEQEIRPLSP<br>RLERLQDPANAVVVVGYSELGPWGSARLRWEIESQGQWTSAGYVEL<br>AWLMNLIRHVNDESYVGWVDTQTGKPVRDGEIQALYGDHIDNHTGIR<br>PIQSTSYNPERMEVLQEVAVEEDLPEFEVSQLTADAMRLRHGANVSIR<br>PSGNPDACHVKLKRGAVILVPKTVPFVWGSCAGELPKGWTPAKYGIPE<br>NLIHQVDPVTLYTICCVAEAFYSAGITHPLEVFRHIHLSELGNFIGSSMG<br>GPTKTRQLYRDVYFDHEIPSDVLQDTYLNTPAAWVNMLLLGCTGPIKT<br>PVGACATGVESIDSGYESIMAGKTKMCLVGGYDDLQEEASYGFAQLK<br>ATVNVEEEIACGRQPSEMSRPMAESRAGFVEAHGCGVQLLCRGDIALQ<br>MGLPIYAVIASSAMAADKIGSSVPAPGQGILSFSRERARSSMISVTSRPS<br>SRSSTSSEVSDKSSLTSITSISNPAPRAQRARSTTDMAPLRAALATWGLT<br>IDDDLDVASLHGTSTRGNDLNEPEVIETQMRHLGRTPGRPLWAICQKSV<br>TGHPKAPAAAWMLNGCLQVLDSGLVPGNRNLDTLDEALRSASHLCFP<br>TRTVQLREVKAFLLTSFGFGQKGGQVVGVAPKYFFATLPRPEVEGYYR<br>KVRVRTEAGDRAYAAAVMSQAVVKIQTQNPYDEPDAPRIFLDPLARIS<br>QDPSTGQYRFRSDATPALDDDALPPPGEPTELVKGISSAWIEEKVRPHM<br>SPGGTVGVDLVPLASFDAYKNAIFVERNYTVRERDWAEKSADVRAAY<br>ASRWCAKEAVFKCLQTHSQGAGAAMKEIEIEHGGNGAPKVKLRGAA<br>QTAARQRGLEGVQLSISYGDDAVIAVALGLMSGAS |
| SEQ ID NO: 4<br>hexanoyl-CoA<br>synthase (AflB)<br>AAS66003.1\| fatty<br>acid synthase beta<br>subunit [Aspergillus<br>sp.] | MGSVSREHESIPIQAAQRGAARICAAFGGQGSNNLDVLKGLLELYKRY<br>GPDLDELLDVASNTLSQLASSPAAIDVHEPWGFDLRQWLTTPEVAPSK<br>EILALPPRSFPLNTLLSLALYCATCRELELDPGQFRSLLHSSTGHSQGIL<br>AAVAITQAESWPTFYDACRTVLQISFWIGLEAYLFTPSSAASDAMIQDC<br>IEHGEGLLSSMLSVSGLSRSQVERVIEHVNKGLGECNRWVHLALVNSH<br>EKFVLAGPPQSLWAVCLHVRRIRADNDLDQSRILFRNRKPIVDILFLPIS<br>APFHTPYLDGVQDRVIEALSSASLALHSIKIPLYHTGTGSNLQELQPHQ<br>LIPTLIRAITVDQLDWPLVCRGLNATHVLDFGPGQTCSLIQELTQGTGV<br>SVIQLTTQSGPKPVGGHLAAVNWEAEFGLRLHANVHGAAKLHNRMT<br>TLLGKPPVMVAGMTPTTVRWDFVAAVAQAGYHVELAGGGYHAERQ<br>FEAEIRRLATAIPADHGIITCNLLYAKPTTFSWQISVIKDLVRQGIVPVEGI<br>TIGAGIPSPEVVQECVQSIGLKHISFKPGSFEAIHQVIQIARTHPNFLIGLQ<br>WTAGRGGGHHSWEDFHGPILATYAQIRSCPNILLVVGSGPGGGPDTFP<br>YLTGQWAQAFGYPCMPFDGVLLGSRMMVAREAHTSAQAKRLIIDAQ<br>GVGDADWHKSFDEPTGGVVTVNSEFGQPIHVLATRGVMLWKELDNR<br>VFSIKDTSKRLEYLRNHRQEIVSRLNADFARPWFAVDGHGQNVELED<br>MTYLEVLRRLCDLTYVSHQKRWVDPSYRILLLDFVHLLRERFQCAIDN<br>PGEYPLDIIVRVEESLKDKAYRTLYPEDVSLLMHLFSRRDIKPVPFIPRL<br>DERFETWFKKDSLWQSEDVEAVIGQDVQRIHIQGPMAVQYSISDDESV<br>KDILHNICNHYVEALQADSRETSIGDVHSITQKPLSAFPGLKVTTNRVQ<br>GLYKFEKVGAVPEMDVLFEHIVGLSKSWARTCLMSKSVFRDGSRLHN<br>PIRAALQLQRGDTIEVLLTADSEIRKIRLISPTGDGGSTSKVVLEIVSNDG |

TABLE 1-continued

Amino acid and nucleotide sequences of the disclosure

| SEQ ID | SEQUENCE |
|---|---|
| | QRVFATLAPNIPLSPEPSVVFCFKVDQKPNEWTLEEDASGRAERIKALY<br>MSLWNLGFPNKASVLGLNSQFTGEELMITTDKIRDFERVLRQTSPLQL<br>QSWNPQGCVPIDYCVVIAWSALTKPLMVSSLKCDLLDLLHSAISFHYA<br>PSVKPLRVGDIVKTSSRILAVSVRPRGTMLTVSADIQRQGQHVVTVKS<br>DFFLGGPVLACETPFELTEEPEMVVHVDSEVRRAILHSRKWLMREDRA<br>LDLLGRQLLFRLKSEKLFRPDGQLALLQVTGSVFSYSPDGSTTAFGRV<br>YFESESCTGNVVMDFLHRYGAPRAQLLELQHPGWTGTSTVAVRGPRR<br>SQSYARVSLDHNPIHVCPAFARYAGLSGPIVHGMETSAMMRRIAEWAI<br>GDADRSRFRSWHITLQAPVHPNDPLRVELQHKAMEDGEMVLKVQAF<br>NERTEERVAEADAHVEQETTAYVFCGQGSQRQGMGMDLYVNCPEAK<br>ALWARADKHLWEKYGFSILHIVQNNPPALTVHFGSQRGRRIRANYLR<br>MMGQPPIDGRHPPILKGLTRNSTSYTFSYSQGLLMSTQFAQPALALME<br>MAQFEWLKAQGVVQKGARFAGHSLGEYAALGACASFLSFEDLISLIFY<br>RGLKMQNALPRDANGHTDYGMLAADPSRIGKGFEEASLKCLVHIIQQ<br>ETGWFVEVVNYNINSQQYVCAGHFRALWMLGKICDDLSCHPQPETVE<br>GQELRAMVWKHVPTVEQVPREDRMERGRATIPLPGIDIPYHSTMLRGE<br>IEPYREYLSERIKVGDVKPCELVGRWIPNVVGQPFSVDKSYVQLVHGIT<br>GSPRLHSLLQQMA |
| SEQ ID NO: 5<br>AAF08793.1\|<br>AF182828_1 geranyl<br>diphosphate synthase<br>large subunit<br>[Mentha x piperita] | MSALVNPVAKWPQTIGVKDVHGGRRRRSRSTLFQSHPLRTEMPFSLYF<br>SSPLKAPATFSVSAVYTKEGSEIRDKDPAPSTSPAFDFDGYMLRKAKSV<br>NKALEAAVQMKEPLKIHESMRYSLLAGGKRVRPMLCIAACELVGGDE<br>STAMPAACAVEMIHTMSLMHDDLPCMDNDDLRRGKPTNHMAFGESV<br>AVLAGDALLSFAFEHVAAATKGAPPERIVRVLGELAVSIGSEGLVAGQ<br>VVDVCSEGMAEVGLDHLEFIHHHKTAALLQGSVVLGAILGGGKEEEV<br>AKLRKFANCIGLLFQVVDDILDVTKSSKELGKTAGKDLVADKTTYPKL<br>IGVEKSKEFADRLNREAQEQLLHFHPHRAAPLIALANYIAYRDN |
| SEQ ID NO: 6<br>AAF08792.1\|<br>AF182827_1 geranyl<br>diphosphate synthase<br>small subunit<br>[Mentha x piperita] | MAINLSHINSKTCFPLKTRSDLSRSSSARCMPTAAAAAFPTIATAAQSQ<br>PYWAAIEADIERYLKKSITIRPPETVFGPMHHLTFAAPATAASTLCLAA<br>CELVGGDRSQAMAAAAAIHLVHAAAYVHEHLPLTDGSRPVSKPAIQH<br>KYGPNVELLTGDGIVPFGFELLAGSVDPARTDDPDRILRVIIEISRAGGP<br>EGMISGLHREEEIVDGNTSLDFIEYVCKKKYGEMHACGAACGAILGGA<br>AEEEIQKLRNFGLYQGTLRGMMEMKNSHQLIDENIIGKLKELALEELG<br>GFHGKNAELMSSLVAEPSLYAA |
| SEQ ID NO: 7<br>Erg20: farnesylpyro<br>phosphate synthase<br>(Saccharomyces sp.) | MASEKEIRRERFLNVFPKLVEELNASLLAYGMPKEACDWYAHSLNYN<br>TPGGKLNRGLSVVDTYAILSNKTVEQLGQEEYEKVAILGWCIELLQAY<br>FLVADDMMDKSITRRGQPCWYKVPEVGEIAINDAFMLEAAIYKLLKS<br>HFRNEKYYIDITELFHEVTFQTELGQLMDLITAPEDKVDLSKFSLKKHS<br>FIVTFKTAYYSFYLPVALAMYVAGITDEKDLKQARDVLIPLGEYFQIQD<br>DYLDCFGTPEQIGKIGTDIQDNKCSWVINKALELASAEQRKTLDENYG<br>KKDSVAEAKCKKIFNDLKIEQLYHEYEESIAKDLKAKISQVDESRGFKA<br>DVLTAFLNKVYKRSK |
| SEQ ID NO: 8<br>Mutated Erg20:<br>farnesylpyro<br>phosphate synthase<br>(K197G) | MASEKEIRRERFLNVFPKLVEELNASLLAYGMPKEACDWYAHSLNYN<br>TPGGKLNRGLSVVDTYAILSNKTVEQLGQEEYEKVAILGWCIELLQAY<br>FLVADDMMDKSITRRGQPCWYKVPEVGEIAINDAFMLEAAIYKLLKS<br>HFRNEKYYIDITELFHEVTFQTELGQLMDLITAPEDKVDLSKFSLKKHS<br>FIVTFGTAYYSFYLPVALAMYVAGITDEKDLKQARDVLIPLGEYFQIQD<br>DYLDCFGTPEQIGKIGTDIQDNKCSWVINKALELASAEQRKTLDENYG<br>KKDSVAEAKCKKIFNDLKIEQLYHEYEESIAKDLKAKISQVDESRGFKA<br>DVLTAFLNKVYKRSK |
| SEQ ID NO: 9<br>GenBank EXX73400<br>acetyl-CoA<br>carboxylase (ACC1)<br>Rhizophagus<br>irregularis DAOM<br>197198w | MRAQAHLGGGLKRIETQHQKGKLTARERAELLLDPGSFNEYDTFVEH<br>QCTDFGMDKNKIIGDGVVTGHGTINGRRVFTFSQDFTAFGGSLSKMHA<br>QKICKIMDKAMLVGAPVIGLNDSGGARIQEGVDSLAGYADIFQRNVLS<br>SGVVPQLSLIMGPCAGGAVYSPALTDFTFMVRDTSYLFVTGPEVVKAV<br>CNEDVTQEELGGANTHTVISGVAHAAFENDIEAIQRIRDFMDFLPLSNR<br>EQAPTRYSDDPIDREDPSLNHIIPVDSTKAYDMREIITRLIDDGHFFEIMP<br>DYAKNIVVGFARMGGKTVSIVGNQPLVSSGVLDINSSVKAARFVRFCD<br>AFNIPIITLVDVPGFLPGTAQEHNGIIRHGAKLLYAYAEATVPKITIITRK<br>AYGGAYDVMSSKHLRGDMNYSWPTGEIAVMGAKGAVEIIFRHVEDR<br>TQSEHEYIDKFANPIPAAQRGYIDDIILPAATRKRIIEDLFVLSHKQLPLI<br>YKKHDNCPL |
| SEQ ID NO: 10<br>Olivetolic acid<br>cyclase (OAC)<br>GenBank AFN42527<br>Cannabis sativa | MAVKHLIVLKFKDEITEAQKEEFFKTYVNLVNIIPAMKDVYWGKDVT<br>QKNKEEGYTHIVEVTFESVETIQDYIIHPAHVGFGDVYRSFWEKLLIFD<br>YTPRK |
| SEQ ID NO: 11<br>Tetraketide synthase<br>(TKS)<br>GenBank B1Q2B6 | MNHLRAEGPASVLAIGTANPENILLQDEFPDYYFRVTKSEHMTQLKEK<br>FRKICDKSMIRKRNCFLNEEHLKQNPRLVEHEMQTLDARQDMLVVEV<br>PKLGKDACAKAIKEWGQPKSITHLIFTSASTTDMPGADYHCAKLLGL<br>SPSVKRVMMYQLGCYGGGTVLRIAKDIAENNKGARVLAVCCDIMACL |

TABLE 1-continued

Amino acid and nucleotide sequences of the disclosure

| SEQ ID | SEQUENCE |
|---|---|
| *Cannabis sativa* | FRGPSESDLELLVGQAIFGDGAAAVIVGAEPDESVGERPIFELVSTGQTI LPNSEGTIGGHIREAGLIFDLHKDVPMLISNNIEKCLIEAFTPIGISDWNSI FWITHPGGKAILDKVEEKLHLKSDKFVDSRHVLSEHGNMSSSTVLFVM DELRKRSLEEGKSTTGDGFEWGVLFGFGPGLTVERVVVRSVPIKY |
| SEQ ID NO: 12 Truncated geranyl pyrophosphate olivetolic acid geranyltransferase (GOT) | MNSIRAATTNQTEPPESDNHSVATKILNFGKACWKLQRPYTIIAFTSCA CGLFGKELLHNTNLISWSLMFKAFFFLVAILCIASFTTTINQIYDLHIDRI NKPDLPLASGEISVNTAWIMSIIVALFGLIITIKMKGGPLYIFGYCFGIFG GIVYSVPPFRWKQNPSTAFLLNFLAHIITNFTFYYASRAALGLPFELRPS FTFLLAFMKSMGSALALIKDASDVEGDTKFGISTLASKYGSRNLTLFCS GIVLLSYVAAILAGIIWPQAFNSNVMLLSHAILAFWLILQTRDFALTNY DPEAGRRFYEFMWKLYYAEYLVYVFIGS |
| SEQ ID NO: 13 Engineered geranyl pyrophosphate olivetolic acid geranyltransferase (GOT) | MKDQRGNSIRASAQIEDRPPESGNLSALTNVKDFVSVCWEYVRPYTAK GVIICSSCLFGRELLENPNLFSWPLIFKAFFFLVAILCIASFTTTINQIYDL HIDRINKPDLPLASGEISVNTAWIMSIIVALFGLIITIKMKGGPLYIFGYCF GIFGGIVYSVPPFRWKQNPSTAFLLNFLAHIITNFTFYYASRAALGLPFE LRPSFTFLLAFMKSMGSALALIKDASDVEGDTKFGISTLASKYGSRNLT LFCSGIVLLSYVAAILAGIIWPQAFNSNVMLLSHAILAFWLILQTRDFAL TNYDPEAGRRFYEFMWKLYYAEYLVYVFTGS |
| SEQ ID NO: 14 Mutant tetrahydro cannabinolic acid synthase (THCAS) | MNCSAFSFWFVCKIIFFFLSFHIQISIANPRENFLKCFSKHIPNNVANPKL VYTQHDQLYMSILNSTIQNLRFISDTTPKPLVIVTPSNNSHIQATILCSKK VGLQIRTRSGGHDAEGMSYISQVPFVVVDLRNMHSIKIDVHSQTAWVE AGATLGEVYYWINEKNENLSFPGGYCPTVGVGGHFSGGGYGALMRN YGLAADNIIDAHLVNVDGKVLDRKSMGEDLFWAIRGGGGENFGIIAA WKIKLVAVPSKSTIFSVKKNMEIHGLVKLFNKWQNIAYKYDKDLVLM THFITKNITDNHGKNKTTVHGYFSSIFHGGVDSLVDLMNKSFPELGIKK TDCKEFSWIDTTIFYSGVVNFNTANFKKEILLDRSAGKKTAFSIKLDYV KKPIPETAMVKILEKLYEEDVGAGMYVLYPYGGIMEEISESAIPFPHRA GIMYELWYTASWEKQEDNEKHINWVRSVYNFTTPYVSQNPRLAYLN YRDLDLGKTNHASPNNYTQARIWGEKYFGKNFNRLVKVKTKVDPNN FFRNEQSIPPLPPHHHGS |
| SEQ ID NO: 15 Truncated tetrahydro cannabinolic acid synthase (THCAS) | MNPRENFLKCFSKHIPNNVANPKLVYTQHDQLYMSILNSTIQNLRFISD TTPKPLVIVTPSNNSHIQATILCSKKVGLQIRTRSGGHDAEGMSYISQVP FVVVDLRNMHSIKIDVHSQTAWVEAGATLGEVYYWINEKNENLSFPG GYCPTVGVGGHFSGGGYGALMRNYGLAADNIIDAHLVNVDGKVLDR KSMGEDLFWAIRGGGGENFGIIAAWKIKLVAVPSKSTIFSVKKNMEIH GLVKLFNKWQNIAYKYDKDLVLMTHFITKNITDNHGKNKTTVHGYFS SIFHGGVDSLVDLMNKSFPELGIKKTDCKEFSWIDTTIFYSGVVNFNTA NFKKEILLDRSAGKKTAFSIKLDYVKKPIPETAMVKILEKLYEEDVGAG MYVLYPYGGIMEEISESAIPFPHRAGIMYELWYTASWEKQEDNEKHIN WVRSVYNFTTPYVSQNPRLAYLNYRDLDLGKTNHASPNNYTQARIWG EKYFGKNFNRLVKVKTKVDPNNFFRNEQSIPPLPPHHHGS |
| SEQ ID NO: 16 Truncated cannabidiolic acid synthase (CBDAS) | MNPRENFLKCFSQYIPNNATNLKLVYTQNNPLYMSVLNSTIHNLRFTS DTTPKPLVIVTPSHVSHIQGTILCSKKVGLQIRTRSGGHDSEGMSYISQV PFVIVDLRNMRSIKIDVHSQTAWVEAGATLGEVYYWVNEKNENLSLA AGYCPTVCAGGHFGGGGYGPLMRNYGLAADNIIDAHLVNVHGKVLD RKSMGEDLFWALRGGGAESFGIIVAWKIRLVAVPKSTMFSVKKIMEIH ELVKLVNKWQNIAYKYDKDLLLMTHFITRNITDNQGKNKTAIHTYFSS VFLGGVDSLVDLMNKSFPELGIKKTDCRQLSWIDTIIFYSGVVNYDTD NFNKEILLDRSAGQNGAFKIKLDYVKKPIPESVFVQILEKLYEEDIGAG MYALYPYGGIMDEISESAIPFPHRAGILYELWYICSWEKQEDNEKHLN WIRNIYNFMTPYVSKNPRLAYLNYRDLDIGINDPKNPNNYTQARIWGE KYFGKNFDRLVKVKTLVDPNNFFRNEQSIPPLPRHRHGS |
| SEQ ID NO: 17 Truncated 3-hydroxy-3-methyl-glutaryl-CoA reductase (HMGR) | MVLTNKTVISGSKVKSLSSAQSSSSGPSSSSEEDDSRDIESLDKKIRPLEE LEALLSSGNTKQLKNKEVAALVIHGKLPYALEKKLGDTTRAVAVRR KALSILAEAPVLASDRLPYKNYDYDRVFGACCENVIGYMPLPVGVIGP LVIDGTSYHIPMATTEGCLVASAMRGCKAINAGGGATTVLTKDGMTR GPVVRFPTLKRSGACKIWLDSEEGQNAIKKAFNSTSRFARLQHIQTCLA GDLLFMRFRTTTGDAMGMNMISKGVEYSLKQMVEEYGWEDMEVVS VSGNYCTDKKPAAINWIEGRGKSVVAEATIPGDVVRKVLKSDVSALV ELNIAKNLVGSAMAGSVGGFNAHAANLVTAVFLALGQDPAQNVESSN CITLMKEVDGDLRISVSMPSIEVGTIGGGTVLEPQGAMLDLLGVRGPH ATAPGTNARQLARIVACAVLAGELSLCAALAAGHLVQSHMTHNRKPA EPTKPNNLDATDINRLKDGSVTCIKS |
| SEQ ID NO: 18 PaaH1: 3-hydroxyacyl-CoA dehydrogenase (*Ralstonia* sp.) | MSIRTVGIVGAGTMGNGIAQACAVVGLNVVMVDISDAAVQKGVATV ASSLDRLIKKEKLTEADKASALARIKGSTSYDDLKATDIVIEAATENYD LKVKILKQIDGIVGENVIIASNTSSISITKLAAVTSRADRFIGMHFFNPVP VMALVELIRGLQTSDTTHAAVEALSKQLGKYPITVKNSPGFVVNRILCP MINEAFCVLGEGLASPEEIDEGMKLGCNHPIGPLALADMIGLDTMLAV MEVLYTEFADPKYRPAMLMREMVAAGYLGRKTGRGVYVYSK |

TABLE 1-continued

Amino acid and nucleotide sequences of the disclosure

| SEQ ID | SEQUENCE |
|---|---|
| SEQ ID NO: 19<br>Crt: crotonase<br>(Clostridium sp.) | MELNNVILEKEGKVAVVTINRPKALNALNSDTLKEMDYVIGEIENDSE<br>VLAVILTGAGEKSFVAGADISEMKEMNTIEGRKFGILGNKVFRRLELLE<br>KPVIAAVNGFALGGGCEIAMSCDIRIASSNARFGQPEVGLGITPGFGGT<br>QRLSRLVGMGMAKQLIFTAQNIKADEALRIGLVNKVVEPSELMNTAK<br>EIANKIVSNAPVAVKLSKQAINRGMQCDIDTALAFESEAFGECFSTEDQ<br>KDAMTAFIEKRKIEGFKNR |
| SEQ ID NO: 20<br>Ter: trans-2-enoyl-<br>CoA reductase<br>(Treponema sp.) | MIVKPMVRNNICLNAHPQGCKKGVEDQIEYTKKRITAEVKAGAKAPK<br>NVLVLGCSNGYGLASRITAAFGYGAATIGVSFEKAGSETKYGTPGWY<br>NNLAFDEAAKREGLYSVTIDGDAFSDEIKAQVIEEAKKKGIKFDLIVYS<br>LASPVRTDPDTGIMHKSVLKPFGKTFTGKTVDPFTGELKEISAEPANDE<br>EAAATVKVMGGEDWERWIKQLSKEGLLEEGCITLAYSYIGPEATQAL<br>YRKGTIGKAKEHLEATAHRLNKENPSIRAFVSVNKGLVTRASAVIPVIP<br>LYLASLFKVMKEKGNHEGCIEQITRLYAERLYRKDGTIPVDEENRIRID<br>DWELEEDVQKAVSALMEKVTGENAESLTDLAGYRHDFLASNGFDVE<br>GINYEAEVERFDRI |
| SEQ ID NO: 21<br>BktB: beta-<br>ketothiolase<br>(Ralstonia sp.) | MTREVVVVSGVRTAIGTFGGSLKDVAPAELGALVVREALARAQVSGD<br>DVGHVVFGNVIQTEPRDMYLGRVAAVNGGVTINAPALTVNRLCGSGL<br>QAIVSAAQTILLGDTDVAIGGGAESMSRAPYLAPAARWGARMGDAGL<br>VDMMLGALHDPFHRIHMGVTAENVAKEYDISRAQQDEAALESHRRAS<br>AAIKAGYFKDQIVPVVSKGRKGDVTFDTDEHVRHDATIDDMTKLRPV<br>FVKENGTVTAGNASGLNDAAAAVVMMERAEAERRGLKPLARLVSYG<br>HAGVDPKAMGIGVPVPATKIALERAGLQVSDLDVIEANEAFAAQACAV<br>TKALGLDPAKVNPNGSGISLGHPIGATGALITVKALHELNRVQGRYAL<br>VTMCIGGGQGIAAIFERI |
| SEQ ID NO: 22<br>MvaE: acetyl-CoA<br>acetyltransferase/HM<br>G-CoA reductase<br>(Enterococcus sp.) | MKEVVMIDAARTPIGKYRGSLSPFTAVELGTLVTKGLLDKTKLKKDKI<br>DQVIFGNVLQAGNGQNVARQIALNSGLPVDVPAMTINEVCGSGMKAV<br>ILARQLIQLGEAELVIAGGTESMSQAPMLKPYQSETNEYGEPISSMVND<br>GLTDAFSNAHMGLTAEKVATQFSVSREEQDRYALSSQLKAAHAVEAG<br>VFSEEIIPVKISDEDVLSEDEAVRGNSTLEKLGTLRTVFSEEGTVTAGNA<br>SPLNDGASVVILASKEYAENNNLPYLATIKEVAEVGIDPSIMGIAPIKAI<br>QKLTDRSGMNLSTIDLFEINEAFAASSIVVSQELQLDEEKVNIYGGAIAL<br>GHPIGASGARILTTLAYGLLREQKRYGIASLCIGGGLGLAVLLEANMEQ<br>THKDVQKKKFYQLTPSERRSQLIEKNVLTQETALIFQEQTLSEELSDHM<br>IENQVSEVEIPMGIAQNFQINGKKKWIPMATEEPSVIAAASNGAKICGNI<br>CAETPQRLMRGQIVLSGKSEYQAVINAVNHRKEELILCANESYPSIVKR<br>GGGVQDISTREFMGSFHAYLSIDFLVDVKDAMGANMINSILESVANKL<br>REWFPEEEILFSILSNFATESLASACCEIPFERLGRNKEIGEQIAKKIQQA<br>GEYAKLDPYRAATHNKGIMNGIEAVVAATGNDTRAVSASIHAYAARN<br>GLYQGLTDWQIKGDKLVGKLTVPLAVATVGGASNILPKAKASLAMLD<br>IDSAKELAQVIAAVGLAQNLAALRALVTEGIQKGHMGLQARSLAISIG<br>AIGEEIEQVAKKLREAEKMNQQTAIQILEKIREK |
| SEQ ID NO: 23<br>MvaS: HMG-CoA<br>synthase<br>(Lactobacillus<br>plantarum) | MKIGIDKLHFATSHLYVDMAELATARQAEPDKYLIGIGQSKMAVIPPS<br>QDVVTLAANAAAPMLTATDIAAIDLLVVGTESGIDNSKASAIYVAKLL<br>GLSQRVRTIEMKEACYAATAGVQLAQDHVRVHPDKKALVIGSDVAR<br>YGLNTPGEPTQGGGAVAMLISADPKVLVLGTESSLLSEDVMDFWRPL<br>YHTEALVDGKYSSNIYIDYFQDVFKNYLQTTQTSPDTLTALVFHLPYT<br>KMGLKALRSVLPLVDAEKQAQWLAHFEHARQLNRQVGNLYTGSLYL<br>SLLSQLLTDPQLQPGNRLGLFSYGSGAEGEFYTGVIQPDYQTGLDHGLP<br>QRLARRRRVSVAEYEALFSHQLQWRADDQSVSYADDPHRFVLTGQK<br>NEQRQYLDQQV |
| SEQ ID NO: 24<br>Erg13: HMG-CoA<br>synthase<br>(Saccharomyces<br>cerevisiae) | MKLSTKLCWCGIKGRLRPQKQQQLHNTNLQMTELKKQKTAEQKTRP<br>QNVGIKGIQIYIPTQCVNQSELEKFDGVSQGKYTIGLGQTNMSFVNDRE<br>DIYSMSLTVLSKLIKSYNIDTNKIGRLEVGTETLIDKSKSVKSVLMQLFG<br>ENTDVEGIDTLNACYGGTNALFNSLNWIESNAWDGRDAIVVCGDIAIY<br>DKGAARPTGGAGTVAMWIGPDAPIVFDSVRASYMEHAYDFYKPDFTS<br>EYPYVDGHFSLTCYVKALDQVYKSYSKKAISKGLVSDPAGSDALNVL<br>KYFDYNVFHVPTCKLVTKSYGRLLYNDFRANPQLFPEVDAELATRDY<br>DESLTDKNIEKTFVNVAKPFHKERVAQSLIVPTNTGNMYTASVYAAFA<br>SLLNYVGSDDLQGKRVGLFSYGSGLAASLYSCKIVGDVQHIIKELDITN<br>KLAKRITETPKDYEAAIELRENAHLKKNFKPQGSIEHLQSGVYYLTNID<br>DKFRRSYDVKK |
| SEQ ID NO: 25<br>Erg10p: acetoacetyl<br>CoA thiolase<br>[Saccharomyces<br>cerevisiae] | MSQNVYIVSTARTPIGSFQGSLSSKTAVELGAVALKGALAKVPELDAS<br>KDFDEIIFGNVLSANLGQAPARQVALAAGLSNHIVASTVNKVCASAMK<br>AIILGAQSIKCGNADVVVAGGCESMTNAPYYMPAARAGAKFGQTVLV<br>DGVERDGLNDAYDGLAMGVHAEKCARDWDITREQQDNFAIESYQKS<br>QKSQKEGKFDNEIVPVTIKGFRGKPDTQVTKDEEPARLHVEKLRSART<br>VFQKENGTVTAANASPINDGAAAVILVSEKVLKEKNLKPLAIIKGWGE |

TABLE 1-continued

Amino acid and nucleotide sequences of the disclosure

| SEQ ID | SEQUENCE |
|---|---|
| | AAHQPADFTWAPSLAVPKALKHAGIEDINSVDYFEFNEAFSVVGLVNT<br>KILKLDPSKVNVYGGAVALGHPLGCSGARVVVTLLSILQQEGGKIGVA<br>AICNGGGGASSIVIEKI |
| SEQ ID NO: 26<br>SCFA-TE: Short<br>chain fatty acyl-CoA<br>thioesterase<br>From BMC Biochem.<br>2011 Aug. 10; 12:44.<br>doi: 10.1186/1471-<br>2091-12-44., e.g.:<br>*Bacteroides* sp.<br>(GenBank: CAH09236,<br>Subfamily F) | MSDDKKIGSYKFIAEPFHVDFNGRLTMGVLGNHLLNCAGFHASERGF<br>GIATLNEDNYTWVLSRLAIDEEMPYQYEEFTVQTWVENVYRLFTDR<br>NFAIIDKDGKKIGYARSVWAMINLNTRKPADLLTLHGGSIVDYVCDEP<br>CPIEKPSRIKVATDQPCAKLTAKYSDIDINGHVNSIRYIEHILDLFPIDLY<br>KSKRIQRFEMAYVAESYYGDELSFFEEEVSENEYHVEIKKNGSEVVCR<br>AKVKFV |
| SEQ ID NO: 27<br>SCFA-TE: Short<br>chain fatty acyl-CoA<br>thioesterase<br>*B. thetaiotaomicron*<br>(GenBank: AAO77182,<br>Subfamily F) | MSEENKIGTYQFVAEPFHVDFNGRLTMGVLGNHLLNCAGFHASDRGF<br>GIATLNEDNYTWVLSRLAIELDEMPYQYEKFSVQTWVENVYRLFTDR<br>NFAVIDKDGKKIGYARSVWAMINLNTRKPADLLALHGGSIVDYICDEP<br>CPIEKPSRIKVTSNQPVATLTAKYSDIDINGHVNSIRYIEHILDLFPIELYQ<br>TKRIRRFEMAYVAESYFGDELSFFCDEVSENEFHVEVKKNGSEVVCRS<br>KVIFE |
| SEQ ID NO: 28<br>SCFA-TE: Short<br>chain fatty acyl-CoA<br>thioesterase<br>*Bryantella*<br>*formatexigen*<br>(GenBank:<br>EET61113,<br>Subfamily H) | MIYMAYQYRSRIRYSEIGEDKKLTLPGLVNYFQDCSTFQSEALGIGLDT<br>LGARQRAWLLASWKIVIDRLPRLGEEVVTETWPYGFKGFQGNRNFRM<br>LDQEGHTLAAAASVWIYLNVESGHPCRIDGDVLEAYELEEELPLGPFS<br>RKIPVPEESTERDSFLVMRSHLDTNHHVNNGQYILMAEEYLPEGFKVK<br>QIRVEYRKAAVLHDTIVPFVCTEPQRCTVSLCGSDEKPFAVVEFSE |
| SEQ ID NO: 29<br>SCFA-TE: Short<br>chain fatty acyl-CoA<br>thioesterase<br>*L. brevis* (GenBank:<br>ABJ63754,<br>Subfamily J) | MAANEFSETHRVVYYEADDTGQLTLAMLINLFVLVSEDQNDALGLST<br>AFVQSHGVGWVVTQYHLHIDELPRTGAQVTIKTRATAYNRYFAYREY<br>WLLDDAGQVLAYGEGIWVTMSYATRKITTIPAEVMAPYHSEEQTRLP<br>RLPRPDHFDEAVNQTLKPYTVRYFDIDGNGHVNNAHYFDWMLDVLP<br>ATFLRAHHPTDVKIRFENEVQYGHQVTSELSQAAALTTQHMIKVGDLT<br>AVKATIQWDNR |
| SEQ ID NO: 30<br>SCFA-TE: Short<br>chain fatty acyl-CoA<br>thioesterase<br>*L. plantarum*<br>(GenBank: CAD63310,<br>Subfamily J) | MATLGANASLYSEQHRITYYECDRTGRATLTTLIDIAVLASEDQSDAL<br>GLTTEMVQSHGVGWVVTQYAIDITRMPRQDEVVTIAVRGSAYNPYFA<br>YREFWIRDADGQQLAYITSIWVMMSQTTRRIVKILPELVAPYQSEVVK<br>RIPRLPRPISFEATDTTITKPYHVRFFDIDPNRHVNNAHYFDWLVDTLPA<br>TFLLQHDLVHVDVRYENEVKYGQTVTAHANILPSEVADQVTTSHLIEV<br>DDEKCCEVTIQWRTLPEPIQ |
| SEQ ID NO: 31<br>SCFA-TE: Short<br>chain fatty acyl-CoA<br>thioesterase<br>*Streptococcus*<br>*dysgalactiae*<br>(GenBank: BAH81730,<br>Subfamily J) | MGLSYREDIKLPFELCDVKSDIKFPLLLDYCLTVSGRQSAQLGRSNDYL<br>LEQYGLIWIVTDYEATIHRLPHFQETITIETKALSYNKFFCYRQFYIYDQ<br>EGGLLVDILAYFALLNPDTRKVATIPEDLVAPFETDFVKKLHRVPKMP<br>LLEQSIDRDYYVRYFDIDMNGHVNNSKYLDWMYDVLGCEFLKTHQPL<br>KMTLKYVKEVSPGGQITSSYHLDQLTSYHQITSDGQLNAQAMIEWRAI<br>KQTESEID |
| SEQ ID NO: 32<br>DXS 1-deoxy-D-<br>xylulose-5-phosphate<br>synthase gene (dxs-<br>AC# 16128405)<br>*Escherichia coli* | MSFDIAKYPTLALVDSTQELRLLPKESLPKLCDELRRYLLDSVSRSSGH<br>FASGLGTVELTVALHYVYNTPFDQLIWDVGHQAYPHKILTGRRDKIGT<br>IRQKGGLHPFPWRGESEYDVLSVGHSSTSISAGIGIAVAAEKEGKNRRT<br>VCVIGDGAITAGMAFEAMNHAGDIRPDMVILNDNEMSISENVGALN<br>NHLAQLLSGKLYSSLREGGKKVFSGVPPIKELLKRTEEHIKGMVVPGT<br>LFEELGFNYIGPVDGHDVLGITTLKNMRDLKGPQFLHIMTKKGRGYE<br>PAEKDPITFHAVPKFDPSSGCLPKSSGGLPSYSKIFGDWLCETAAKDNK<br>LMAITPAMREGSGMVEFSRKFPDRYFDVAIAEQHAVTFAAGLAIGGYK<br>PIVAIYSTFLQRAYDQVLHDVAIQKLPVLFAIDRAGIVGADGQTHQGAF<br>DLSYLRCIPEMVIMTPSDENECRQMLYTGYHYNDGPSAVRYPRGNAV<br>GVELTPLEKLPIGKGIVKRRGEKLAILNFGTLMPEAAKVAESLNATLVD<br>MRFVKPLDEALILEMAASHEALVTVEENAIMGGAGSGVNEVLMAHRK<br>PVPVLNIGLPDFFIPQGTQEEMRAELGLDAAGMEAKIKAWLA |
| SEQ ID NO: 33<br>DXR/IspC 1-deoxy-<br>D-xylulose 5- | MKQLTILGSTGSIGCSTLDVVRHNPEHFRVVALVAGKNVTRMVEQCL<br>EFSPRYAVMDDEASAKLLKTMLQQQGSRTEVLSGQQAACDMAALED<br>VDQVMAATVGAAGLLPTLAAIRAGKTILLANKESLVTCGRLFMDAVK |

TABLE 1-continued

Amino acid and nucleotide sequences of the disclosure

| SEQ ID | SEQUENCE |
|---|---|
| phosphate reductoisomerase [Escherichia coli] AC# 16128166 | QSKAQLLPVDSEHNAIFQSLPQPIQHNLGYADLEQNGVVSILLTGSGGP FRETPLRDLATMTPDQACRHPNWSMGRKISVDSATMMNKGLEYIEAR WLFNASASQMEVLIHPQSVIHSMVRYQDGSVLAQLGEPDMRTPIAHT MAWPNRVNSGVKPLDFCKLSALTFAAPDYDRYPCLKLAMEAFEQGQ AATTALNAANEITVAAFLAQQIRFTDIAALNLSVLEKMDMREPQCVDD VLSVDANAREVARKEVMRLAS |
| SEQ ID NO: 34 IspD 2-C-methyl-D-erythritol 4-phosphate cytidylyltransferase [Escherichia coli] AC# 190908496 | MATTHLDVCAVVPAAGFGRRMQTECPKQYLSIGNQTILEHSVHALLA HPRVKRVVIAISPGDSRFAQLPLANHPRITVVDGGEERADSVLAGLKA AGDAQWVLVHDAARPCLHQDDLARLLALSETSRTGGILAAPVRDTM KRAEPGKNAIAHTVDRNGLWHALTPQFFPRELLHDCLTRALNEGATIT DEASALEYCGFHPQLVEGRADNIKVTRPEDLALAEFYLTRTIHQENT |
| SEQ ID NO: 35 IspE 4-diphosphocytidyl-2-C-methylerythritol kinase [Escherichia coli] AC# 4062791 | MRTQWPSPAKLNLFLYITGQRADGYHTLQTLFQFLDYGDTISIELRDD GDIRLLTPVEGVEHEDNLIVRAARLLMKTAADSGRLPTGSGANISIDKR LPMGGGLGGGSSNAATVLVALNHLWQCGLSMDELAEMGLTLGADVP VFVRGHAAFAEGVGEILTPVDPPEKWYLVAHPGVSIPTPVIFKDPELPR NTPKRSIETLLKCEFSNDCEVIARKRFREVDAVLSWLLEYAPSRLTGTG ACVFAEFDTESEARQVLEQAPEWLNGFVAKGANLSPLHRAML |
| SEQ ID NO: 36 IspF 2C-methyl-D-erythritol 2,4-cyclodiphosphate synthase [Escherichia coli F11] AC# 190908583 | MRIGHGFDVHAFGGEGPIIIGGVRIPYEKGLLAHSDGDVVLHALTDALL GAAALGDIGKLFPDTDPAFKGADSRELLREAWRRIQAKGYALGNVDV TIIAQAPRMLPHIPQMRVFIAEDLGCHMDDVNVKATTTEKLGFTGRGE GIACEAVALLIKATK |
| SEQ ID NO: 37 IspG 4-hydroxy-3-methylbut-2-en-1-yl diphosphate synthase [Escherichia coli F11] CDU37657 | MHNQAPIQRRKSTRIYVGNVPIGDGAPIAVQSMTNTRTTDVEATVNQI KALERVGADIVRVSVPTMDAAEAFKLIKQQVNVPLVADIHFDYRIALK VAEYGVDCLRINPGNIGNEERIRMVVDCARDKNIPIRIGVNAGSLEKDL QEKYGEPTPQALLESAMRHVDHLDRLNFDQFKVSVKASDVFLAVESY RLLAKQIDQPLHLGITEAGGARSGAVKSAIGLGLLLSEGIGDTLRVSLA ADPVEEIKVGFDILKSLRIRSRGINFLACPTCSRQEFDVIGTVNALEQRLE DIITPMDVSIIGCVVNGPGEALVSTLGVTGGNKKSGLYEDGVRKDRLD NNDMIDQLEARIRAKASQLDEARRIDVQQVEK |
| SEQ ID NO: 38 IspH 4-hydroxy-3-methylbut-2-enyl diphosphate reductase [Escherichia coli F11] AC# 190905591 | MQILLANPRGFCAGVDRAISIVENALAIYGAPIYVRHEVVHNRYVVDS LRERGAIFIEQISEVPDGAILIFSAHGVSQAVRNEAKSRDLTVFDATCPL VTKVHMEVARASRRGEESILIGHAGHPEVEGTMGQYSNPEGGMYLVE SPDDVWKLTVKNEEKLSFMTQTTLSVDDTSDVIDALRKRFPKIVGPRK DDICYATTNRQEAVRALAEQAEVVLVVGSKNSSNSNRLAELAQRMGK RAFLIDDATDIQEEWVKEAKCVGVTAGASAPDILVQNVVARLQQLGG GEAIPLEGREENIVFEVPKELRVDIREVD |
| SEQ ID NO: 39 IDI: isopentenyl diphosphate (IPP) isomerase (GenBank AKF73239) Escherichia coli | MQTEHVILLNAQGVPTGTLEKYAAHTADTRLHLAFSSWLFNAKGQLL VTRRALSKKAWPGVWTNSVCGHPQLGESNEDAVIRRCRYELGVEITPP ESIYPDFRYRATDPSGIVENEVCPVFAARTTSALQINDDEVMDYQWCD LADVLHGIDATPWAFSPWMVMQATNREARKRLSAFTQLK |
| SEQ ID NO: 40 Mutated IspA* FPP synthase (S81F) for GPP production (ispA-AC# NP_414955) | MDFPQQLEACVKQANQALSRFIAPLPFQNTPVVETMQYGALLGGKRL RPFLVYATGHMFGVSTNTLDAPAAAVECIHAYSLIHDDLPAMDDDDL RRGLPTCHVKFGEANAILAGDALQTLAFSILSDADMPEVSDRDRISMIS ELASASGIAGMCGGQALDLDAEGKHVPLDALERIHRHKTGALIRAAV RLGALSAGDKGRRALPVLDKYAESIGLAFQVQDDILDVVGDTATLGK RQGADQQLGKSTYPALLGLEQARKKARDLIDDARQSLKQLAEQSLDT SALEALADYIIQRNK |
| SEQ ID NO: 41 Malonyl CoA-acyl carrier protein transacylase (MCT1) Saccharomyces cerevisiae | atgaagctactaaccttcccaggtcaagggacctccatctccatttcgatattaaaagcgataataagaaacaaat caagagaattccaaacaatactgagtcagaacggcaaggaatcaaatgatctattgcagtacatcttccagaacc cttccagccccggaagcattgcagtctgctccaacctttttctatcaattgtaccagatactctcgaatcctctgatcc tcaagatcaagcaccaaaaaatatgactaagatcgattcccccgacaagaaagacaatgaacaatgttacctttggg tcactcgctaggcgagttaacatgtctgagtgttaattcactgtttttcgttaaaggatctttttgatattgctaattta gaaataagttaatggtaacatctactgaaaagtacttagtagcccacaatatcaacagatccaacaaatttgaaatg tgggcactctcttctccgagggcacagatttaccgcaagaagtgcaaaaactactaaattcccctaatttattatc atcttcacaaaataccatttctgtagcaaatgcaaattcagtaaagcaatgtgtagtcaccggtctggttgatgattta gagtccttaagaacagaatttgaacttaaggttccgcgtttaagaattacagaattaactaacccatacaacatcc cttccataatagcactgtgttgaggcccgttcaggaaccactctatgactacatttgggatatattaaagaaaacg gaactcacacgttgatggagttgaaccatccaataatagctaacttagatggtaatatatcttactatattcatcatgc cctagatgattcgttaagtgttcaagcaggactgtgcaattcaccatgtgttatgataccataaactctggaaccc cagtggaaattgataagagtatttgctttggcccgggcaatgtgatttataaccttattcggagaaattgtccccaag tggacactatagaatacctcttttagcaactatagacgcttatcacaaggcggcagaggagaacaaagattga |

TABLE 1-continued

Amino acid and nucleotide sequences of the disclosure

| SEQ ID | SEQUENCE |
|---|---|
| SEQ ID NO: 42<br>malonyl CoA-acyl<br>carrier protein<br>transacylase (MCT1)<br>Saccharomyces<br>cerevisiae | MKLLTFPGQGTSISISILKAIIRNKSREFQTILSQNGKESNDLLQYIFQNPS<br>SPGSIAVCSNLFYQLYQILSNPSDPQDQAPKNMTKIDSPDKKDNEQCYL<br>LGHSLGELTCLSVNSLFSLKDLFDIANFRNKLMVTSTEKYLVAHNINRS<br>NKFEMWALSSPRATDLPQEVQKLLNSPNLLSSSQNTISVANANSVKQC<br>VVTGLVDDLESLRTELNLRFPRLRITELTNPYNIPFHNSTVLRPVQEPLY<br>DYIWDILKKNGTHTLMELNHPIIANLDGNISYYIHHALDRFVKCSSRTV<br>QFTMCYDTINSGTPVEIDKSICFGPGNVIYNLIRRNCPQVDTIEYTSLATI<br>DAYHKAAEENKD* |
| SEQ ID NO: 43<br>Artificial beta-<br>ketothiolase (BktB)<br>nucleotide sequence | atgactagagaagttgtcgtcgtttccggtgtccgtaccgctatcggtactttcggtggttccttaaaggatgttgct<br>cctgctgaattgggtgctttagttgttagagaagctttggccagagcccaagtctccggtgacgacgttggtcacg<br>tcgttttcggtaacgtcatccaaactgaaccacatgactgtactgtcggttccggttacaagctattgtctctgccgcccaaact<br>accatcaacgctcctgccttaactgttaacagattatgtgattggttccggtttacaagctattgtctctgccgcccaaact<br>atcttgttgggtgatactgacgttgctattggtggtggtgctgaatctatgtctagagctccatacttggctccagctg<br>cccgttggggtgctagaatgggtgacgccggtttggtcgatatgatgttgggtgccttgcatgatcctttccacag<br>aatccacatgggtgttaccgctgaaaacgtctgctaaggaatacagatatctctagagctcaacaagatgaagccgc<br>tttagaatctcacagacgtgcctccgccgctattaaggctggttacttcaaggaccaaattgttccagttgtctctaa<br>gggtcgtaaaggtgatgttacctttgatactgacgaacacgttagacacgacgccactattgacgatatgactaaa<br>ttaagaccagtctttgttaaggagaatggtaccgttactgctggtaacgcttctggttttgaacgatgccgccgctgc<br>cgttgttatgatggaaagagctgaagccgaaagacgtggtttaaagccattggccagattagtctcctacggtca<br>cgctggtgtcgacccaaaggctatgggtatcggtccagttcctgctactaagattgcttttagaaagagctggtttg<br>caagtttctgacttggacgtcatcgaagccaacgaagccttcgctgctcaagcttgtgctgtcaccaaggctttgg<br>gtttggatccagctaaagttaaccctaatggttctggtatttccttgggtcacccaatcggtgctaccggtgctttaat<br>cactgttaaagccttacacgaattgaacagagttcaaggtagatacgctttggtcactatgtgcatcggtggtggtc<br>aaggtatcgctgctatcttcgaaagaatcggatcctaa |
| SEQ ID NO: 44<br>Engineered beta-<br>ketothiolase (BktB) | MTREVVVVSGVRTAIGTFGGSLKDVAPAELGALVVREALARAQVSGD<br>DVGHVVFGNVIQTEPRDMYLGRVAAVNGGVTINAPALTVNRLCGSGL<br>QAIVSAAQTILLGDTDVAIGGGAESMSRAPYLAPAARWGARMGDAGL<br>VDMMLGALHDPFHRIHMGVTAENVAKEYDISRAQQDEAALESHRRAS<br>AAIKAGYFKDQIVPVVSKGRKGDVTFDTDEHVRHDATIDDMTKLRPV<br>FVKENGTVTAGNASGLNDAAAAVVMMERAEAERRGLKPLARLVSYG<br>HAGVDPKAMGIGPVPATKIALERAGLQVSDLDVIEANEAFAAQACAV<br>TKALGLDPAKVNPNGSGISLGHPIGATGALITVKALHELNRVQGRYAL<br>VTMCIGGGQGIAAIFERIGS* |
| SEQ ID NO: 45<br>Artificial PaaH1: 3-<br>hydroxyacyl-CoA<br>dehydrogenase<br>nucleotide sequence | atgtccatcagaactgtcggtattgttggtgctggtactatgggtaacggtattgctcaagcctgtgctgtcgtcggt<br>ttgaacgtcgtcatggtcgacattctgacgctgctgttcaaaagggtgttgctactgtcgctctcctcttggacagat<br>taattaagaaggaaaagttgaccgaagccgacaaggcctctgccttggccagaattaagggttccacttcttatg<br>acgacttgaaagctaccgacattgttatcgaagctgctactgaaaactacgatttgaaagttaagatcttgaagcaa<br>attgatggtatcgtcggtgagaacgtcatttattgcttctaacacttcctccatttctatcactaaattagccgccgtca<br>cctctagagccgacagatttatcggtatgcacttctttaatccagttccagtcatgcatttggtcgaattaattagag<br>tttgcaaacctccgacaccacccacgccgccgttgaagctttgtctaagcaattgggtaagtacccaatcaccgtt<br>aaaaattccccaggtttcgttgtcaaccgtattttgtgcccaatgatcaatgaagctttctgtgtcttgggtgaggtt<br>tggcctcccagaagaaatcgatgaaggtatgaagttaggttgtaaccaccctattggtccttagccttggccga<br>catgatcggtttagacactatgttggccgttatgaagtcttgtacactgaattcgctgacccaaagtacagaccag<br>ctatgttaatgagagaaatggttgctgccggttatttgggtagaaagactggtcgtggtgtttatgtctactctaaag<br>ggatc |
| SEQ ID NO: 46<br>Engineered PaaH1:<br>3-hydroxyacyl-CoA<br>dehydrogenase | MSIRTVGIVGAGTMGNGIAQACAVVGLNVVMVDISDAAVQKGVATV<br>ASSLDRLIKKEKLTEADKASALARIKGSTSYDDLKATDIVIEAATENYD<br>LKVKILKQIDGIVGENVIIASNTSSISITKLAAVTSRADRFIGMHFFNPVP<br>VMALVELIRGLQTSDTTHAAVEALSKQLGKYPITVKNSPGFVVNRILCP<br>MINEAFCVLGEGLASPEEIDEGMKLGCNHPIGPLALADMIGLDTMLAV<br>MEVLYTEFADPKYRPAMLMREMVAAGYLGRKTGRGVYVYSKGI |
| SEQ ID NO: 47<br>Artificial crotonase<br>(Crt) nucleotide<br>sequence | atggaattgaacaacgttattttggaaaaggaaggtaaggtcgctgtcgttactatcaacagaccaaaggctttaa<br>acgctttgaactctgacaccttgaaagaaatggattatgttatcggtgaaatcgaaaatgactctgaagttttggcc<br>gttatcttgactggtgctggtgaaaaatcttcgttgctggtgctgacatttctgaaatgaaggagatgaataccatt<br>gaaggtagaaagttcggtatcttgggtaacaaggttttagaagattggaattgttggaaaaaccagtcatcgctg<br>ctgttaacggtttcgctttaggtggtggttgtgaaatcgctatgtcctgtgacattcgtatcgcctcctccaatgctag<br>attcggtcaaccagaagttggtttaggtattactccaggtttcggtggtaccaaagattgctctagattggtcggtat<br>gggtatggcaagcaattaattttcactgctcaaaacattaaggctgatgaagccttacgtattggtttggtcaacaa<br>ggtcgttgaaccatctgaattgatgaataccgctaaggaaattgctaacaaaattgtttctaatgccccagttgctgt<br>caagttgtccaagcaagctattaacagaggtatgcaatgtgatattgacactgctttggctttcgaatccgaagctt<br>tggtgaatgtttttctaccgaagatcaaaaggatgctatgaccgctttcatcgagaagagaaagatcgaaggtttc<br>aaaaacagaggatcctaa |
| SEQ ID NO: 48<br>Engineered crotonase<br>(Crt) | MELNNVILEKEGKVAVVTINRPKALNALNSDTLKEMDYVIGEIENDSE<br>VLAVILTGAGEKSFVAGADISEMKEMNTIEGRKFGILGNKVFRRLELLE<br>KPVIAAVNGFALGGGCEIAMSCDIRIASSNARFGQPEVGLGITPGFGGT<br>QRLSRLVGMGMAKQLIFTAQNIKADEALRIGLVNKVVEPSELMNTAK<br>EIANKIVSNAPVAVKLSKQAINRGMQCDIDTALAFESEAFGECFSTEDQ<br>KDAMTAFIEKRKIEGFKNRGS* |

TABLE 1-continued

Amino acid and nucleotide sequences of the disclosure

| SEQ ID | SEQUENCE |
| --- | --- |
| SEQ ID NO: 49<br>Artificial Ter:<br>trans-2-enoyl-CoA<br>reductase nucleotide<br>sequence | atgattgtcaaaccaatggttcgtaacaacatttgtttaaatgcccacccacaaggttgtaagaagggtgttgaaga<br>tcaaatcgaatacactaaaaagagaattaccgctgaagttaaagctggtgctaaggcccccaaagaacgttttggtt<br>ttggggttgttccaacggttacggtttggcctccagaattactgctgcttttggttacggtgccgctaccatcggtgtct<br>ctttcgaaaaggccggttccgaaactaagtacggtactccaggttggtacaataacttggctttcgatgaagctgc<br>taagagagaaggttttgtattccgttactattgacggtgatgccttttctgacgaaatcaaagctcaagtcatcgaag<br>aagccaaaaagaaaggtatcaagttcgatttgattgtctactctttagcctctcctgttagaactgatccagatactg<br>gtattatgcacaaatccgttttgaagccattcggtaagaccttcactggtaaaactgtcgatcctttcactggtgaatt<br>aaaggaaatctctgctgaacctgccaacgacgaagaagctgctgccactgttaaggttatgggtggtgaagact<br>gggaaagatggatcaagcaattatctaaggaaggtttgttggaagaaggttgtatcaccttggcttactcttacatc<br>ggtccagaagctacccaagctttgtacagaaagggtaccattggtaaggctaaagaacacttggaggctactgc<br>tcatagattgaacaaggaaaatccatccatcagagcctttgtttccgtcaataaaggtttggtcactagagcctctg<br>ccgtcattccagttatcccttatacttggcttcttgtttaaagtcatgaaggaaaagggtaaccatgaaggttgtat<br>cgaacaaatcactcgtttgtacgctgaacgtttatacagaaaggacggtaccatccctgtcgatgaagaaaacag<br>aatcagaatcgacgattgggaattggaagaagatgttcaaaaagccgtttccgcctgatggaaaaggtcaccg<br>gtgaaatgccgaatccttgactgacttagctgctgttacagacatgacttttttagcttctaatggtttcgatgttgaagg<br>tattaactatgaggctgaagtcgaaagatttgacagaatcggatcctaa |
| SEQ ID NO: 50<br>Engineered Ter:<br>trans-2-enoyl-CoA<br>reductase | MIVKPMVRNNICLNAHPQGCKKGVEDQIEYTKKRITAEVKAGAKAPK<br>NVLVLGCSNGYGLASRITAAFGYGAATIGVSFEKAGSETKYGTPGWY<br>NNLAFDEAAKREGLYSVTIDGDAFSDEIKAQVIEEAKKKGIKFDLIVYS<br>LASPVRTDPDTGIMHKSVLKPFGKTFTGKTVDPFTGELKEISAEPANDE<br>EAAATVKVMGGEDWERWIKQLSKEGLLEEGCITLAYSYIGPEATQAL<br>YRKGTIGKAKEHLEATAHRLNKENPSIRAFVSVNKGLVTRASAVIPVIP<br>LYLASLFKVMKEKGNHEGCIEQITRLYAERLYRKDGTIPVDEENRIRID<br>DWELEEDVQKAVSALMEKVTGENAESLTDLAGYRHDFLASNGFDVE<br>GINYEAEVERFDRIGS* |
| SEQ ID NO: 51<br>Truncated 3-hydroxy-<br>3-methyl-glutaryl-<br>CoA reductase<br>(tHMG1) | atggcgcgtgaccaattggtgaaaactgaagtcaccaagaagtcttttactgctcctgtacaaaaggcttctacac<br>cagttttaaccaataaaacagtcatttctggatcgaaagtcaaaagtttatcatctgcgcaatcgagctcatcagga<br>ccttcatcatctagtgaggaagatgattcccgcgatattgaaagctggatcagaaaatacgtccttttagaagaatt<br>agaagcattattaagtagtggaaatacaaaccaattgaagaacaaagaggtcgctgccttggttattcacggtaa<br>gttacctttgtacgctttggagaaaaaattaggtgatactacgagagcggttgcggtacgtaggaaggctcttt ca<br>attttggcagaagctcctgtattagcatctgatcgtttaccatataaaaattatgactacgaccgcgtatttggcgctt<br>gttgtgaaaatgttataggttacatgcctttgcccgttggtgttataggccccttggttatcgatgtatactttatcat<br>ataccaatggcaactacgagggttgtttggtagcttctgccatgcgtggctgtaaggcaatcaatgctggcggt<br>ggtgcaacaactgttttaactaaggatggtatgacaagaggcccagtagtccgtttcccaacttgaaaagatctg<br>gtgcctgtaagatatggttagactcagaagagggacaaaacgcaattaaaaaagcttttaactctacatcaagattt<br>gcacgtctgcaacatattcaaacttgtctagcaggagatttgtt |
| SEQ ID NO: 52<br>Truncated 3-hydroxy-<br>3-methyl-glutaryl-<br>CoA reductase (tHMG1) | MARDQLVKTEVTKKSFTAPVQKASTPVLTNKTVISGSKVKSLSSAQSS<br>SSGPSSSSEEDDSRDIESLDKKIRPLEELEALLSSGNTKQLKNKEVAALV<br>IHGKLPLYALEKKLGDTTRAVAVRRKALSILAEAPVLASDRLPYKNYD<br>YDRVFGACCENVIGYMPLPVGIGPLVIDGTSYHIPMATTEGCLVASA<br>MRGCKAINAGGGATTVLTKDGMTRGPVVRFPTLKRSGACKIWLDSEE<br>GQNAIKKAFNSTSRFARLQHIQTCLAGDL |
| SEQ ID NO: 53<br>Artificial acetyl-CoA<br>acetyltransferase/<br>HMG-CoA reductase<br>(mvaE) nucleotide<br>sequence | atgaagactgtcgttatcatagatgccttgagaacaccaatcggtaaatacaaaggttcattatcccaagtttccgc<br>cgttgacttaggtactcatgttactacacaattgttgaagagacactccacaatcagtgaagaaatcgatcaagtca<br>tattcggtaacgtattgcaagctggtaatggtcaaaacccagccagacaaatagctatcaattctggtttatcacat<br>gaaattcctgctatgacagtaaacgaagtttgtggttcaggcatgaaagcagtcattttggccaagcaattgataca<br>attaggtgaagcagaagtttttaatcgccggtggtatagaaaacatgagtcaagctccaaaattgcaaagattcaat<br>tacgaaactgaatcttacgatgcaccttttctcttcgatgatgtatgatggttttgactgacgcttttttctggtcaagcaat<br>gggtttaacagctgaaatgtcgcagaaaagtaccatgtaaccagagaagaacaagatcaattttccgttcacag<br>tcaattaaaagctgcacaagcacaagccgaaggtattttcgccgacgaaatagctccattggaagtttctggtaca<br>ttagtcgaaaaggatgaaggtattagacctaactccagtgttgaaaaattgggtactttgaagacgtattcaagg<br>aagacgtacagttaccgctggtaatgcctctaccattaacgatggtgctagtgcattgattatagcttctcaagaa<br>tatgccgaagctcatggtttgccatacttagctatcattagagatagtgtagaagttggtattgacccagcatacatg<br>ggtatctctcctataaaagcaatccaaaagttgttagccagaaaccaattgaccactgaagaaattgatttgtacga<br>aattaacgaagcatttgccgctacatcaatcgttgtccaaagaaattggcattgccagaagaaaaggttaacatc<br>tatggtggtggtatctcccttgggtcacgctataggtgcaaccggtgccagattgttgacttccttaagttaccaattg<br>aaccaaaaggaaagaaatacggtgttgcttcttatgcattggtggtggtttgggtttagcaatgttgttagaaaga<br>ccacaacaaaagaaaattctagattctaccaaatgtccccctgaagaaagattggcctcattgttaaatgaaggtc<br>aaatttccgcagatactaagaaagaattttgaaaaccaccgcttatcttcacaaatcgcaaaccatatgatcgaaaac<br>caaatctctgaaacagaagttccaatgggtgtcggtttgcacttaactgtcgatgaaacagactatttggtaccaat<br>ggctaccgaagaacctagtgttatcgcagcctttatctaatggtgctaagatagcacaaggttttaagactgttaacc<br>aacaaagattgatgagaggtcaaatcgtattctacgatgttgctgacccagaatcattaatcgataagttgcaagta<br>agagaagcgaagtttttttcaacaagctgaattgtcttacccttcaatagttaagagaggtgggtgtttgagagattt<br>gcaatacgaacttttgacgaatcctcgtcagttagattttcttagttgatgtcaaggacgccatgggtgctaatat<br>tgttaacgcaatgttggaaggtgtcgccgaattgtttagagaatggttcgctgaacaaaagattttgttttctatcttgt<br>caaactacgctacagaatctgtagttaccatgaaaactgcaattccagtttccagattgagtaagggttctaacggt<br>agagaaatcgctgaaaagattgttttggcatcaagatatgcctccttagaccccttacagagctgttactcataataa<br>gggtataatgaacggtatcgaagctgtcgtattagcaaccggtaatgatactagagcagtatctgcctcatgtcac<br>gcattcgccgttaaggaaggtagataccaaggtttgacatcatggaccttgatggtgaacaattaattggtgaaa<br>tatccgttccattggctttagcaactgttggtggtgctacaaaagtcttgcctaagagtcaagctgcagccgatttgt<br>tagccgtcactgacgctaaggaattgtctagagttgtcgctgcagtaggtttagctcaaaatttggccgctttaaga<br>gcattggttcagaaggtattcaaaaaggtcatatggctttgcaagcaagatccttagccatgacagttggtgctac |

TABLE 1-continued

Amino acid and nucleotide sequences of the disclosure

| SEQ ID | SEQUENCE |
|---|---|
| | cggtaaagaagtcgaagccgtagctcaacaattaaaaagacaaaagacaatgaaccaagacagagcaatggc tatattaaacgatttgagaaagcaataa |
| SEQ ID NO: 54<br>MvaE: acetyl-CoA acetyltransferase/ HMG-CoA reductase (Enterococcus sp.) | MKTVVIIDALRTPIGKYKGSLSQVSAVDLGTHVTTQLLKRHSTISEEID QVIFGNVLQAGNGQNPARQIAINSGLSHEIPAMTVNEVCGSGMKAVIL AKQLIQLGEAEVLIAGGIENMSQAPKLQRFNYETESYDAPFSSMMYDG LTDAFSGQAMGLTAENVAEKYHVTREEQDQFSVHSQLKAAQAQAEGI FADEIAPLEVSGTLVEKDEGIRPNSSVEKLGTLKTVFKEDGTVTAGNAS TINDGASALIIASQEYAEAHGLPYLAIIRDSVEVGIDPAYMGISPIKAIQK LLARNQLTTEEIDLYEINEAFAATSIVVQRELALPEEKVNIYGGGISLGH AIGATGARLLTSLSYQLNQKEKKYGVASLCIGGGLGLAMLLERPQQK KNSRFYQMSPEERLASLLNEGQISADTKKEFENTALSSQIANHMIENQI SETEVPMGVGLHLTVDETDYLVPMATEEPSVIAALSNGAKIAQGFKTV NQQRLMRGQIVFYDVADPESLIDKLQVREAEVFQQAELSYPSIVKRGG GLRDLQYRTFDESFVSVDFLVDVKDAMGANIVNAMLEGVAELFREWF AEQKILFSILSNYATESVVTMKTAIPVSRLSKGSNGREIAEKIVLASRYA SLDPYRAVTHNKGIMNGIEAVVLATGNDTRAVSASCHAFAVKEGRYQ GLTSWTLDGEQLIGEISVPLALATVGGATKVLPKSQAAADLLAVTDAK ELSRVVAAVGLAQNLAALRALVSEGIQKGHMALQARSLAMTVGATG KEVEAVAQQLKRQKTMNQDRAMAILNDLRKQ* |
| SEQ ID NO: 55<br>MvaS: HMG-CoA synthase (Enterococcus sp.) | atgacaattgggattgataaaattagtttttttgtgccccttattatattgatatgacggcactggctgaagccagaa atgtagaccctggaaaatttcatattggtattgggcaagaccaaatggcggtgaacccaatcagccaagatattgt gacatttgcagccaatgccgcagaagcgatcttgaccaaagaagataaagaggccattgatatggtgattgtcg ggactgagtccagtatcgatgagtcaaaagcggccgcagttgtcttacatcgtttaatggggattcaacctttcgct cgctcttttcgaaatcaaggaagcttgttacggagcaacagcaggcttacagttagctaagaatcacgtagccttac atccagataaaaaagtcttggtcgtagcggcagatattgcaaaatatgcttaaattctggcggtgagcctacaca aggagctgggcggttgcaatgttagttgctagtgaaccgcgcattttggcttaaaagaggataatgtgatgctg acgcaagatatctatgacttttgcgtccaacaggccaccgtatcctatggtcgatggtcctttgtcaaacgaaa cctacatccaatcttttgcccaagtctgggatgaacatataaaaacgaaccggtcttgattttgcagattatgatgcttt agcgttccatattccttacacaaaaatgggcaaaaaagccttattagcaaaaatctccgaccaaactgaagcaga acaggaacgaattttagcccgttatgaagaaagtatcgtctatagtcgtcgcgtaggaaacttgtatacgggttca ctttatctgggactcatttcccttttagaaaatgcaacgactttaaccgcaggcaatcaaattggtttattcagttatgg ttctggtgctgtcgctgaatttttcactggtgaattagtagctggtttatcaaaatcattacaaaaagaaactcatttag cactgctggataatcggacagaactttctatcgctgaatatgaagccatgtttgcagaaactttagacacagacatt gatcaaacgttagaagatgaattaaaatatagtatttctgctattaataataccgttcgttcgttcttatcgaaactaa |
| SEQ ID NO: 56<br>MvaS: HMG-CoA synthase (Enterococcus sp.) | MTIGIDKISFFVPPYYIDMTALAEEARNVDPGKFHIGIGQDQMAVNPISQ DIVTFAANAEAILTKEDKEAIDMVIVGTESSIDESKAAAVVLHRLMGI QPFARSFEIKEACYGATAGLQLAKNHVALHPDKKVLVVAADIAKYGL NSGGEPTQGAGAVAMLVASEPRILALKEDNVMLTQDIYDFWRPTGHP YPMVDGPLSNETYIQSFAQVWDEHKKRTGLDFADYDALAFHIPYTKM GKKALLAKISDQTEAEQERILARYEESIVYSRRVGNLYTGSLYLGLISLL ENATTLTAGNQIGLFSYGSGAVAEFFTGELVAGYQNHLQKETHLALLD NRTELSIAEYEAMFAETLDTDIDQTLEDELKYSISAINNTVRSYRN* |
| SEQ ID NO: 57<br>Isopentenyl pyrophosphate isomerase (Sc_IDI1) Saccharomyces sp. | atgactgccgacaacaatagtatgccccatggtgcagtatctagttacgccaaattagtgcaaaaccaaacacct gaagacatttttggaagagtttcctgaaattattccattacaacaaagacctaataccgatctagtgagacgtcaaa tgacgaaagcggagaaacatgttttctggtcatgatgaggagcaaattaagttaatgaatgaaaattgtattgtttt ggattgggacgataatgctattggtgccggtaccaaagaaagtttgtcatttaatggaaatattgaaaagggttac tacatcgtgcattctccgtctttattttcaatgaacaaggtgaattcttttacaacaaagagccactgaaaaaataac tttccctgatctttggactaacacatgctgctctcatccactatgtattgatgacgaattaggtttgaagggtaagcta gacgataagattaagggcgctattactgcggcggtgagaaaactagatcatgaattaggtattccagaagatgaa actaagacaaggggtaagttcacttttttaaacagaatccattacatggcaccaagcaatgaaccatgggtgaa catgaaaattgattacatcctatttttataagatcaacgctaaagaaaacttgactgtcaacccaaacgtcaatgaagtt agagacttcaaatgggtttcaccaaatgatttgaaaactatgtttgctgacccaagttacaagtttacgccttggttta agattatttgcgagaattacttattcaactggtgggagcaattagatgacctttctgaagtggaaaatgacaggcaa attcatagaatgctataa |
| SEQ ID NO: 58<br>Isopentenyl pyrophosphate isomerase (Sc_IDI1) Saccharomyces sp. | MTADNNSMPHGAVSSYAKLVQNQTPEDILEEFPEIIPLQQRPNTRSSET SNDESGETCFSGHDEEQIKLMNENCIVLDWDDNAIGAGTKKVCHLME NIEKGLLHRAFSVFIFNEQGELLLQQRATEKITFPDLWTNTCCSHPLCID DELGLKGKLDDKIKGAITAAVRKLDHELGIPEDETKTRGKFHFLNRIHY MAPSNEPWGEHEIDYILFYKINAKENLTVNPNVNEVRDFKWVSPNDLK TMFADPSYKFTPWFKIICENYLFNWWEQLDDLSEVENDRQIHRML |
| SEQ ID NO: 59<br>Mutant farnesyl pyrophosphate synthase (Erg20mut, F96W, N127W) | atggcttcagaaaaagaaattaggagagagagattcttgaacgttttccctaaattagtagaggaattgaacgcat cgcttttggcttacggtatgcctaaggaagcatgtgactggtatgcccactcattgaactacaacactccaggcgg taagctaaatagaggtttgtccgttgtggacacgtatgctattctctccaacaagaccgttgaacaattggggcaa gaagaatacgaaaaggttgccattctaggttggtgcattgagttgttgcaggcttactggttggtcgccgatgatat gatggcaagtccattaccagaagaggccaacatgttggtacaaggttcctgaagttgggaaattgccatctg ggacgcattcatttagaggctgctatcacaagcttttgaaatctcacttcagaaacgaaaaatactacatagatat caccgaattgttccataggtcaccttccaaaccgaattgggcaattgatgacttaatcactgcacctgaagac aaagtcgacttgagtaagttctccctaaagaagcactccttcatagttactttcaagactgcttactattcttctactt gcctgtcgcattggccatgtacgttgccggtatcacggatgaaaaggatttgaaacaagccagagatgtcttgatt ccattgggtgaatacttccaaattcaagatgactactagactgcttccggtaccccagaacagatcggtaagatcg |

TABLE 1-continued

Amino acid and nucleotide sequences of the disclosure

| SEQ ID | SEQUENCE |
|---|---|
| | gtacagatatccaagataacaaatgttcttgggtaatcaacaaggcattggaacttgcttccgcagaacaaagaa<br>agactttagacgaaaattacggtaagaaggactcagtcgcagaagccaaatgcaaaaagatttttcaatgacttga<br>aaattgaacagctataccacgaatatgaagagtctattgccaaggatttgaaggccaaaatttctcaggtcgatga<br>gtctcgtggcttcaaagctgatgtcttaactgcgttcttgaacaaagtttacaagagaagcaaatag |
| SEQ ID NO: 60<br>Mutant farnesyl<br>pyrophosphate<br>synthase (Erg20mut,<br>F96W, N127W) | MASEKEIRRERFLNVFPKLVEELNASLLAYGMPKEACDWYAHSLNYN<br>TPGGKLNRGLSVVDTYAILSNKTVEQLGQEEYEKVAILGWCIELLQAY<br>WLVADDMMDKSITRRGQPCWYKVPEVGEIAIWDAFMLEAAIYKLLKS<br>HFRNEKYYIDITELFHEVTFQTELGQLMDLITAPEDKVDLSKFSLKKHS<br>FIVTFKTAYYSFYLPVALAMYVAGITDEKDLKQARDVLIPLGEYFQIQD<br>DYLDCFGTPEQIGKIGTDIQDNKCSWVINKALELASAEQRKTLDENYG<br>KKDSVAEAKCKKIFNDLKIEQLYHEYEESIAKDLKAKISQVDESRGFKA<br>DVLTAFLNKVYKRSK* |
| SEQ ID NO: 61<br>Phosphomevalonate<br>kinase (Sc_ERG8)<br>Saccharomyces sp. | atgtcagagttgagagccttcagtgcccagggaaagcgttactagctggtggatatttagttttagatacaaaata<br>tgaagcatttgtagtcggattatcggcaagaatgcatgctgtagcccatcttacggttcattgcaagggtctgata<br>agtttgaagtgcgtgtgaaaagtaaacaatttaaagatggggagtggctgtaccatataagtcctaaaagtggctt<br>cattcctgtttcgataggcggatctaagaacccttcattgaaaaagttatcgctaacgtatttagctactttaaaccta<br>acatggacgactactgcaatagaaacttgttcgttattgatattttctctgatgatgcctaccattctcaggaggatag<br>cgttaccgaacatcgtggcaacagaagattgagttttcattcgcacagaattgaagaagttcccaaaacagggct<br>gggctcctcggcaggtttagtcacagttttaactgcactgcttcctttttttgtatcggacctggaaataatgta<br>gacaaatatagagaagttcatataattttagcacaagttgctcattgtcaagctcagggtaaaattggaagcgggtt<br>tgatgtagcggcggcagcatatggatctatcagatatagaagattcccacccgcattaatctctaatttgccagata<br>ttggaagtgctacttacggcagtaaactggcgcatttggttgatgaagaagactggaatattacgattaaaagtaa<br>ccatttaccttcgggattaactttatggatgggcgatattagaaatggttcagaaacagtaaaactggtccagaag<br>gtaaaaaattggtatgattcgcatattgccagaaagctttgaaaatatatacagaactcgatcatgcaaattctagattt<br>atgatggactatctaaactagatcgcttacacgagactcatgacgattacagcgatcagatatttgagtctcttga<br>gaggaatgactgtacctgtcaaaagtatcctgaaatcacagaagttagagatgcagttgccacaattagacgttcc<br>tttagaaaataactaaagaatctggtgccgatatcgaacctcccgtacaaactagcttattggatgattgccagac<br>cttaaaaggagttcttacttgcttaatacctggtgctggtggttatgacgccattgcagtgattactaagcaagatgtt<br>gatcttagggctcaaaccgctaatgacaaaagattttctaaggttcaatggctggatgtaactcaggctgactggg<br>gtgttaggaaagaaaaagatccggaaacttatcttgataaataa |
| SEQ ID NO: 62<br>Phosphomevalonate<br>kinase (Sc_ERG8)<br>Saccharomyces sp. | MSELRAFSAPGKALLAGGYLVLDTKYEAFVVGLSARMHAVAHPYGSL<br>QGSDKFEVRVKSKQFKDGEWLYHISPKSGFIPVSIGGSKNPFIEKVIANV<br>FSYFKPNMDDYCNRNLFVIDIFSDDAYHSQEDSVTEHRGNRRLSFHSH<br>RIEEVPKTGLGSSAGLVTVLTTALASFFVSDLENNVDKYREVIHNLAQ<br>VAHCQAQGKIGSGFDVAAAAYGSIRYRRFPPALISNLPDIGSATYGSKL<br>AHLVDEEDWNITIKSNHLPSGLTLWMGDIKNGSETVKLVQKVKNWYD<br>SHMPESLKIYTELDHANSRFMDGLSKLDRLHETHDDYSDQIFESLERN<br>DCTCQKYPEITEVRDAVATIRRSFRKITKESGADIEPPVQTSLLDDCQTL<br>KGVLTCLIPGAGGYDAIAVITKQDVDLRAQTANDKRFSKVQWLDVTQ<br>ADWGVRKEKDPETYLDK* |
| SEQ ID NO: 63<br>ERG12-mevalonate<br>kinase<br>(Saccharomyces sp.) | atgtcattaccgttcttaacttctgcaccgggaaaggttattatttttggtgaacactctgctgtgtacaacaagcctg<br>ccgtcgctgctagtgtgtctgcgttgagaacctacctgctaataagcgagtcatctgcaccagatactattgaattg<br>gactttcccggacattagctttaatcataagtggtccatcaatgattcaatgccatcaccgaggatcaagtaaactc<br>caaaaattggccaaggctcaacaagcaccgatggcttgtctcaggaactcgttagtcttttggatccgttgttag<br>ctcaactatccgaatccttccactaccatgcagcgttttgtttcctgtatatgtttgttgcctatgccccatgccaag<br>aatattaagttttcttaaagtctacttacccatccggtgctgggttgggctcaagcgcctctatttctgtatcactggc<br>cttagctatggcctacttgggggggttaatagggatctaatgacttggaaaagctgtcagaaaacgataagcatata<br>gtgaatcaatgggccttcataggtgaaaagtgtattcacggtacccttcaggaatagataacgctgtggccactt<br>atggtaatgccctgctattgaaaaagactcacataatggaacaataaacacaaacaatttaagttcttagatgattt<br>cccagccattccaatgatcctaacctatactagaattccaaggtctacaaaagatcttgttgctcgcgttcgtgtgtt<br>ggtcaccgagaaatttcctgaagttatgaagccaattctagatgccatgggtgaatgtgccctacaaggcttagag<br>atcatgactaagttaagtaaatgtaaaggcaccgatgacgaggctgtagaaactaataatgaactgtatgaacaa<br>ctattggaattgataagaataaatcatgggactgcttgtctcaatcggtgtttctcatcctggattagaacttattaaaaa<br>tctgagcgatgatttgagaattggctccacaaaacttaccggtgctggtggcggcggttgctctttgactttgttac<br>gaagagacattacttcaagagcaaattgacagcttcaaaaagaaattgcaagatgattttagttacgagacatttga<br>aacagactttgggtgggactggctgctgtttgttaagcgcaaaaaatttgaataaagatcttaaaatcaaatccctag<br>tattccaattatttgaaaataaaactaccacaaagcaacaaattgacgatctattattgccaggaaacacgaatttac<br>catggacttcataa |
| SEQ ID NO: 64<br>ERG12-mevalonate<br>kinase<br>(Saccharomyces sp.) | MSLPFLTSAPGKVIIFGEHSAVYNKPAVAASVSALRTYLLISESSAPDTI<br>ELDFPDISFNHKWSINDFNAITEDQVNSQKLAKQQATDGLSQELVSLL<br>DPLLAQLSESFPHYAAFCFLYMFVCLCPHAKNIKFSLKSTLPIGAGLGS<br>SASISVSLALAMAYLGGLIGSNDLEKLSENDKHIVNQWAFTGEKCIHGT<br>PSGIDNAVATYGNALLFEKDSHNGTINTNNFKFLDDFPAIPMILTYTRIP<br>RSTKDLVARVRVLVTEKFPEVMKPILDAMGECALQGLEIMTKLSKCK<br>GTDDEAVETNNELYEQLLELIRINHGLLVSIGVSHPGLELIKNLSDDLRI<br>GSTKLTGAGGGGCSLTLLRRDITQEQIDSFKKKLQDDFSYETFETDLGG<br>TGCCLLSAKNLNKDLKIKSLVFQLFENKTTTKQQIDDLLLPGNTNLPW<br>TS* |
| SEQ ID NO: 65<br>Mevalonate | atgaccgtttacacagcatccgttaccgcacccgtcaacatcgcaacccttaagtattggggaaaagggacac<br>gaagttgaatctgcccaccaattcgtccatatcagtgactttatcgcaagatgacctcagaacgttgacctctgcg |

TABLE 1-continued

Amino acid and nucleotide sequences of the disclosure

| SEQ ID | SEQUENCE |
|---|---|
| pyrophosphate decarboxylase (Sc_ERG19) Saccharomyces sp. | gctactgcacctgagtttgaacgcgacactttgtggttaaatggagaaccacacagcatcgacaatgaaagaact caaaattgtctgcgcgacctacgccaattaagaaaggaaatggaatcgaaggacgcctcattgcccacattatct caatggaaactccacattgtctccgaaaataactttcctacagcagctggtttagcttcctccgctgctggctttgct gcattggtctctgcaattgctaagttataccaattaccacagtcaacttcagaaatatctagaatagcaagaaaggg gtctggttcagcttgtgatcgttgtttggcggatacgtggcctgggaaatgggaaaagctgaagatggtcatgat tccatggcagtacaaatcgcagacagctctgactggcctcagatgaaagcttgtgtcctagttgtcagcgatatta aaaaggatgtgagttccactcagggtatgcaattgaccgtggcaacctccgaactatttaaagaaagaattgaac atgtcgtaccaaagagatttgaagtcatgcgtaaagccattgttgaaaaagatttcgccacctttgcaaaggaaac aatgatggattccaactcttttccatgccacatgtttggactctttccctccaatattctacatgaatgacacttccaag cgtatcatcagttggtgccacaccattaatcagttttacggagaaacaatcgttgcatacacgtttgatgcaggtcc aaatgctgtgttgtactacttagctgaaaatgagtcgaaactctttgcatttatctataaattgtttggctctgttcctgg atgggacaagaaatttactactgagcagcttgaggctttcaaccatcaatttgaatcatctaacttactgcacgtga attggatcttgagttgcaaaaggatgttgccagagtgatttttaactcaagtcggttcaggcccacaagaaacaaac gaatctttgattgacgcaaagactggtctaccaaaggaataa |
| SEQ ID NO: 66 Mevalonate pyrophosphate decarboxylase (Sc_ERG19) Saccharomyces sp. | MTVYTASVTAPVNIATLKYWGKRDTKLNLPTNSSISVTLSQDDLRTLT<br>SAATAPEFERDTLWLNGEPHSIDNERTQNCLRDLRQLRKEMESKDASL<br>PTLSQWKLHIVSENNFPTAAGLASSAAGFAALVSAIAKLYQLPQSTSEI<br>SRIARKGSGSACRSLFGGYVAWEMGKAEDGHDSMAVQIADSSDWPQ<br>MKACVLVVSDIKKDVSSTQGMQLTVATSELFKERIEHVVPKRFEVMR<br>KAIVEKDFATFAKETMMDSNSFHATCLDSFPPIFYMNDTSKRIISWCHT<br>INQFYGETIVAYTFDAGPNAVLYYLAENESKLFAFIYKLFGSVPGWDK<br>KFTTEQLEAFNHQFESSNFTARELDLELQKDVARVILTQVGSGPQETNE<br>SLIDAKTGLPKE* |
| SEQ ID NO: 67 Engineered phosphomevalonate kinase/mevalonate kinase (Erg8-T2A-Erg12) | atgtcagagttgagagccttcagtgcccagggaaagcgttactagctggtggatatttagttttagatacaaaata tgaagcatttgtagtcggattatcggcaagaatgcatgctgtagcccatcctacggttcattgcaagggtctgata agtttgaagtgcgtgtgaaaagtaaacaattaaagatggggagtggctgtaccatataagtcctaaaagtggctt cattcctgtttcgataggcggatctaagaacccttcattgaaaaagttatcgctaacgtatttagctactttaaaccta acatggacgactactgcaatagaaactgttcgttattgatattttctctgatgatgcctaccattctcaggaggatag cgttaccgaacatcgtggcaacagaagattgagttttcattcgcacagaattgaagaagttcccaaaacagggct gggctcctcggcaggtttagtcacagttttaactacagctttggcctccttttttgtatcggacctggaaaataatgta gacaaatatagagaagttattcataatttagcacaagttgctcattgtcaagctcagggtaaaattggaagcgggtt tgatgtagccggcggcagcatatggatctatcagatatagaagattcccacccgcattaatctctaattgccagata ttggaagtgctacttacggcagtaaactggcgcattgtggttgatgaagaagactggaatattacgattaaaagtaa ccatttaccttcgggattaactttatggatgggcgatattaagaatggttcagaaacagtaaaactggtccagaag gtaaaaaattggtatgattcgcatatgccagaaagcttgaaaatatatacagaactcgatcatgcaaattctagattt atggatggcatatctaaactagatcgcttacacgagactcatgacgattacagcgatcagatatttgagtctcttga gaggaatgactgtacctgtcaaaagtatcctgaaatcacagaagttagagatgcagttgccacaattagacgttcc tttagaaaaataactaaagaatctggtgccgatatcgaacctcccgtacaaactagcttattggatgattgccagac cttaaaaggagttcttacttgcttaatacctggtgctggtggttatgacgccattgcagtgattactaagcaagatgtt gatcttagggctcaaaccgctaatgacaaaagattttcttaaggttcaatggctggatgtaactcaggctgactggg tgttaggaaagaaaaagatccggaaacttatcttgataaaaagcttgagggcagaggaagtcttctaacatgcg gtgacgtggaggagaatccccggccctgctagcatgtcattaccgttcttaacttctgcaccgggaaaggttattat tttggtgaacactctgctgtgtacaacaagcctgccgtcgctgctagtgtgtctgcgttgagaacctacctgctaat aagcagtcatctgcaccagatactattgaattggacttcccggacattagcttttaatcataagtggtccatcaatg atttcaatgccatcaccgaggatcaagtaaactcccaaaaattggccaaggctcaacaagccaccgatggcttgt ctcaggaactcgttagtctttggatccgttgttagctcaactatccgaatccttccactaccatgcagcgtttttgttttc ctgtatatgtttgtttgcctatgccccatgccaagaatattaagttttctttaaagtctactttacccatcggtgctggg ttgggctcaagcgcctctattttctgtatcactggccttagctatggcctacttgggggggttaataggatctaatgac ttggaaaagctgtcagaaaacgataagcatatagtgaatcaatgggccttcattggtgaaaagtgtattcacggta cccttcaggaatagataacgctgtggccacttatggtaatgccctgctatttgaaaaagactcacataatggaac aataaacacaaacaattttaagtcttagatgatttcccagccattccaatgatcctaacctatactagaattccaagg tctacaaaagatcttgttgctcgcgttcgtgtgttggtcaccgagaaatttcctgaagttatgaagccaattctagat gccatgggtgaatgtgccctacaaggcttagagatcatgactaagttaagtaaatgtaaaggcaccgatgacga ggctgtagaaactaataatgaactgtatgaacaactattggaattgataagaataaatcatggactgcttgtctcaat cggtgtttctcatcctggattagaacttattaaaaatctgagcgatgatttgagaattggctccacaaaacttaccgg tgctggtggcggcggttgctcttttgactttgttacgaagagacattactcaagagcaaattgacagcttcaaaaag aaattgcaagatgattttagttacgagacatttgaaacagacttggggtgggactggctgctgtttgttaagcgcaaa aaatttgaataaagatcttaaatcaaatccctagtattccaattatttgaaaataaaactaccacaaagcaacaatt gacgatctattattgccaggaaacacgaatttaccatggacttcataa |
| SEQ ID NO: 68 Engineered phosphomevalonate kinase/mevalonate kinase (Erg8-T2A-Erg12) | MSELRAFSAPGKALLAGGYLVLDTKYEAFVVGLSARMHAVAHPYGSL<br>QGSDKFEVRVKSKQFKDGEWLYHISPKSGFIPVSIGGSKNPFIEKVIANV<br>FSYFKPNMDDYCNRNLFVIDIFSDDAYHSQEDSVTEHRGNRRLSFHSH<br>RIEEVPKTGLGSSAGLVTVLTTALASFFVSDLENNVDKYREVIHNLAQ<br>VAHCQAQGKIGSGFDVAAAAYGSIRYRRFPPALISNLPDIGSATYGSKL<br>AHFVDEEDWNITIKSNHFPSGLTLWMGDIKNGSETVKLVQKVKNWYD<br>SHMPESLKIYTELDHANSRFMDGLSKLDRLHETHDDYSDQIFESLERN<br>DCTCQKYPEITEVRDAVATIRRSFRKITKESGADIEPPVQTSLLDDCQTL<br>KGVLTCLIPGAGGYDAIAVITKQDVDLRAQTANDKRFSKVQWLDVTQ<br>ADWGVRKEKDPETYLDKKLEGRGSLLTCGDVEENPGPASMSLPFLTS<br>APGKVIIFGEHSAVYNKPAVAASVSALRTYLLISESSAPDTIELDFPDISF<br>NHKWSINDFNAITEDQVNSQKLAKAQQATDGLSQELVSLLDPLLAQLS<br>ESFHYHAAFCFLYMFVCLCPHAKNIKFSLKSTLPIGAGLGSSASISVSLA<br>LAMAYLGGLIGSNDLEKLSENDKHIVNQWAFIGEKCIHGTPSGIDNAV |

TABLE 1-continued

Amino acid and nucleotide sequences of the disclosure

| SEQ ID | SEQUENCE |
|---|---|
| | ATYGNALLFEKDSHNGTINTNNFKFLDDFPAIPMILTYTRIPRSTKDLV<br>ARVRVLVTEKFPEVMKPILDAMGECALQGLEIMTKLSKCKGTDDEAV<br>ETNNELYEQLLELIRINHGLLVSIGVSHPGLELIKNLSDDLRIGSTKLTG<br>AGGGGCSFTFFRRDITQEQIDSFKKKLQDDFSYETFETDFGGTGCCFLS<br>AKNLNKDLKIKSLVFQLFENKTTTKQQIDDLLLPGNTNLPWTS* |
| SEQ ID NO: 69<br>Artificial neryl<br>pyrophosphate (NPP)<br>synthase (NPPS)<br>nucleotide sequence | atgtgctcacttaatttgcaaacggaaaagctatgctatgaagacaatgacaatgacttggacgaggaactgatg<br>ccgaagcacatagcgctaatcatggatggtaatagacgtttgggcaaaagacaagggcttagaagtgtacgaag<br>ggcacaaacatataatcccgaaactaaaagaaatatgtgacatatcctccaagttggggattcagatcatcacag<br>cgttcgcgttctccacagagaactggaagagatccaaggaggaagtcgatttcctattgcagatgtttgaagaaat<br>ctatgacgaatttagccgttctggggtgagagtgagtatcatcggatgcaaaagcgatttgccgatgacccttcaa<br>aaatgtatcgcattgacagaggaaacgacgaaaggcaataagggattacacctggtcatagcacttaactacgg<br>tgggtattacgatatcctacaagcaacgaagtccattgtaaacaaggctatgaatgttttattggacgttgaagaca<br>tcaataaaaatctgttcgaccaagaattagaaagcaaatgccctaaccctgacttgctgatcagaactggggag<br>aacagagggtctctaattttcttctatggcaattggcttatactgagttctattttaccaatacttattccctgactttg<br>gtgaagaggacctgaaagaagccatcatgaattttcaacagagacaccgtagattcggaggacatacttattga |
| SEQ ID NO: 70<br>Neryl pyrophosphate<br>(NPP) synthase<br>(NPPS)<br>Solanum sp. | MCSFNFQTEKLCYEDNDNDLDEELMPKHIALIMDGNRRWAKDKGLE<br>VYEGHKHIIPKLKEICDISSKLGIQIITAFAFSTENWKRSKEEVDFLLQMF<br>EEIYDEFSRSGVRVSIIGCKSDLPMTLQKCIALTEETTKGNKGLHLVIAL<br>NYGGYYDILQATKSIVNKAMNGFFDVFDINKNFFDQFFFSKCPNPDFF<br>IRTGGEQRVSNFLLWQLAYTEFYFTNTLFPDFGEEDLKEAIMNFQQRH<br>RRFGGHTY* |
| SEQ ID NO: 71<br>Artificial<br>geranylgeranyl<br>pyrophosphate<br>synthase large<br>subunit (GPPS1su)<br>nucleotide sequence | atgagcaccgtgaatctgacctgggcagacgtgctctatgttcaaccagggcgggcgttcccgttcattgtca<br>accttcaacttaaatctgtaccatccattgaagaaaacgccttctctatccagacacctaagcagaaaaggccaa<br>cttccccccttctcatctatcagtgccgtattaacggagcaggaagcagtaaaggagggtgacgaggaaaaaagc<br>atatttaacttcaaatcttatatggttcagaaagctaatagcgtgaatcaggcactagattctgcggtgttattgagag<br>accccattatgatacatgaatctatgcgttactcttgcttgcgggcggcaagcgtgtcagaccgatgttatgcttaa<br>gtgcgtgcgagttagtagggaggtaaagagtctgtagcaatgcccgcagcatgtgctgtagaaatgatacacaca<br>atgtcactgattcacgatgatcttccttgcatggataacgacgatcttcgtagaggtaagccaaccaaccacaagg<br>tattcggggaagacgtggcagtttagcaggagacgcgctactagcgttcgcgtttgaacacatggcagttagca<br>cagtaggagttccagcagcaaaaatagttagggctataggagagttagcaaagtccatcggtagcgagggcctt<br>gttgccggacaggtagttgatatcgatagtgaaggtgcctaacgtggcactagaacaactggagttcatccac<br>ctacacaagacaggggcactgcttgaagcgagtgttgtacttggggctattctggggggaggaacagatgagg<br>aggtagaaaaactacgtagttttgccaggtgtataggactactatttcaagttgtagatgatatcttgacgtcacga<br>agagtagtcaagagttaggaaaaacagcagggaaagatctagttgccgataaagtaacctaccccaggctaat<br>gggtatcgataaatctcgtgagttcgccgaacaattaaatactgaggctaagcaacatttaagcgggtttgatccta<br>ttaaggctgcgccgctgattgctctagcaaactatattgcatatagacagaactga |
| SEQ ID NO: 72<br>Geranylgeranyl<br>pyrophosphate<br>synthase large<br>subunit (GPPS1su)<br>Cannabis sativa | MSTVNLTWVQTCSMFNQGGRSRSLSTFNLNLYHPLKKTPFSIQTPKQK<br>RPTSPFSSISAVLTEQEAVKEGDEEKSIFNFKSYMVQKANSVNQALDSA<br>VLLRDPIMIHESMRYSLLAGGKRVRPMLCLSACELVGGKESVAMPAA<br>CAVEMIHTMSLIHDDLPCMDNDDLRRGKPTNHKVFGEDVAVLAGDA<br>LLAFAFEHMAVSTVGVPAAKIVRAIGELAKSIGSEGLVAGQVVDISE<br>GLANVGLEQLEFIHLHKTGALLEASVVLGAILGGGTDEEVEKLRSFAR<br>CIGLLFQVVDDILDVTKSSQELGKTAGKDLVADKVTYPRLMGIDKSRE<br>FAEQLNTEAKQHLSGFDPIKAAPLIALANYIAYRQN* |
| SEQ ID NO: 73<br>Artificial<br>geranylgeranyl<br>pyrophosphate<br>synthase small<br>subunit (GPPSssu)<br>nucleotide sequence | atggctgtttacaacctttcaatcaactgttctcccagattcgtccatcatgtatacgtgccccattttacatgtaaatc<br>aaataagagcctgagccatgtccccatgagaatcacgatgtcaaagcagcatcatcactcatactttgcctctaca<br>acggcagatgtcgatgccatctaaaacaatcaatcacaattaaaccccgttgtctgtccacgaagccatgtata<br>actttatcttcagtacgccaccgaatttggcgccatcattatgtgtcgcagcatgtgaattggttggggggtcaccag<br>ggacaggcgatggcagcggccagcgcattaagggtaatacatgctagcatcgttacccacgatcaccttccgtt<br>aacgggaaggccaaaccccacctcaccggaggccgctacgcacaattcctataatccaaacatacagttgttatt<br>acctgacgccattacacccttcgggtttgagctattagcgtccagtgatgatcttacacacaacaagagtgagaga<br>gttcttagggtgatcgttgaatttacgaggacttcggttccagaggcactatagacgccaataccacgaaaagt<br>tggctagtaggtttgatgtggatagccatgaggcaaagaccgtaggatggggcattacccatcattgaaaaag<br>gagggagccatgcacgcatgtgctgctgcctgcggagcaatattgggtgaggctcatgaagaagaagtggaa<br>aaattgcgtacattcgggctgtatgtcggcatgatccaaggttatgcgaacagattcatcatgagcagtacagag<br>gagaaaaaagaggctgacaggataattgaggagcttaccaatttagcgcgtcaggagctgaaatacttcgatgg<br>aaggaacctagaaccgttttcaacattcttgttccgtttgtag |
| SEQ ID NO: 74<br>Geranylgeranyl<br>pyrophosphate<br>synthase small<br>subunit (GPPSssu)<br>Cannabis sativa | MAVYNLSINCSPRFVHHVYVPHFTCKSNKSLSHVPMRITMSKQHHHSY<br>FASTTADVDAHLKQSITIKPPLSVHEAMYNFIFSTPPNLAPSLCVAACEL<br>VGGHQGQAMAAASALRVIHASIVTHDHLPLTGRPNPTSPEAATHNSYN<br>PNIQLLLPDAITPFGFELLASSDDLTHNKSERVLRVIVEFTRTFGSRGTID<br>AQYHEKLASRFDVDSHEAKTVGWGHYPSLKKEGAMHACAAACGAIL<br>GEAHEEEVEKLRTFGLYVGMIQGYANRFIMSSTEEKKEADRIIEELTNL<br>ARQELKYFDGRNLEPFSTFLFRL* |
| SEQ ID NO: 75<br>Artificial tetraketide<br>synthase (TKS)<br>nucleotide sequence | atgaatcatttaagagctgaaggtccagcctccgttttggccatcggtaccgctaaccctgaaaacattttgttgca<br>agacgaattcccagactactacttcagagtcactaagtccgaacacatgacccaattgaaggagaagttcagaa<br>agatttgtgacaagtccatgattagaaagagaaactgtttcttgaacgaagaacacttgaagcaaaacccaagatt<br>ggttgaacatgaaatgcaaactttggacgctagacaagacatgttggttgttgaagtccctaagttgggtaaggat<br>gcctgtgctaaggccattaaagaatggggtcaacctaagtccaagattacccacttgattttcacctctgcctccac |

TABLE 1-continued

Amino acid and nucleotide sequences of the disclosure

| SEQ ID | SEQUENCE |
|---|---|
| | cactgacatgcctggtgctgattaccactgcgctaagttattgggtttgtctccatccgttaagagagttatgatgta<br>ccaattgggttgctacggtggtggtactgttttaagaattgctaaggatattgctgaaaacaacaagggtgccaga<br>gtcttagctgtctgctgtgacattatggcttgtttattcagaggtccatctgaatccgacttggaattgttggttggtca<br>agctatcttcggtgacggtgctgctgccgttattgttggtgctgaaccagacgaatccgttggtgaaagaccaatt<br>ttgaattggtttccaccggtcaaactattttgccaaattccgaaggtaccatcggtggtcatatcagagaagccggt<br>ttgatcttcgacttacataaggatgtcccaatgttgatctctaacaacattgaaaagtgtttgatcgaagcttttaccc<br>caattggtatttctgactggaactctatcttctggattacccatcctggtggtaaggctattttggataaggtcgagga<br>aaaattgcacttgaagtctgacaagttcgttgactctagacacgtcttgtccgaacatggtaatatgtcctcttccac<br>cgttttattcgttatggatgagttgagaaagagatccttagaagaaggtaagtccaccaccggtgatggttttgagt<br>ggggtgttttgttcggtttcggtccaggtttgaccgtcgaaagagttgttgttagatctgtcccaattaagtacggat<br>cc |
| SEQ ID NO: 76<br>Artificial tetraketide<br>synthase (TKS) | MNHLRAEGPASVLAIGTANPENILLQDEFPDYYFRVTKSEHMTQLKEK<br>FRKICDKSMIRKRNCFLNEEHLKQNPRLVEHEMQTLDARQDMLVVEV<br>PKLGKDACAKAIKEWGQPKSKITHLIFTSASTTDMPGADYHCAKLLGL<br>SPSVKRVMMYQLGCYGGGTVLRIAKDIAENNKGARVLAVCCDIMACL<br>FRGIPSESDLELLVGIQAIFGDGAAAVIVGAEPDESVG1ERPIFELVSTGIQTI<br>LPNSEGTIGGHIREAGLIFDLHKDVPMLISNNIEKCLIEAFTPIGISDWNSI<br>FWITHPGGKAILDKVEEKLHLKSDKFVDSRHVLSEHGNMSSSTVLFVM<br>DELRKRSLEEGKSTTGDGFEWGVLFGFGPGLTVERVVVRSVPIKYGS |
| SEQ ID NO: 77<br>Artificial olivetolic<br>acid cyclase (OAC)<br>nucleotide sequence | atggccgtcaagcacttgatcgttttgaagttcaaggatgaaatcactgaagctcaaaaggaagaattcttcaaaa<br>cctacgtcaacttagtcaatattattccagccatgaaggacgtctattggggtaaggacgttactcaaaagaataa<br>ggaggaaggttatactcatatcgttgaggtcactttcgaatctgttgagactattcaagactacatcatccacccag<br>cccacgttggtttcggtgatgtttatcgttccttctgggaaaaattgttgatcttcgactacacccctagaaagggat<br>cc |
| SEQ ID NO: 78<br>Artificial olivetolic<br>acid cyclase (OAC) | MAVKHLIVLKFKDEITEAQKEEFFKTYVNLVNIIPAMKDVYWGKDVT<br>QKNKEEGYTHIVEVTFESVETIQDYIIHPAHVGFGDVYRSFWEKLLIFD<br>YTPRKGS |
| SEQ ID NO: 79<br>Fusion tetraketide<br>synthase-olivetolic<br>acid cyclase (TKS-<br>OAC) | atgaatcatttaagagctgaaggtccagcctccgttttggccatcggtaccgctaaccctgaaaacatttgttgca<br>agacgaattcccagactactacttcagagtcactaagtccgaacacatgacccaattgaaggagaagttcagaa<br>agatttgtgacaagtccatgattagaaagagaaactgtttcttgaacgaagaacacttgaagcaaaacccaagatt<br>ggttgaacatgaaatgcaaactttggacgctagacaagacatgttggttgttgaagtccctaagttgggtaaggat<br>gcctgtgctaaggccattaaagaatggggtcaacctaagtccaagattacccacttgattttcacctctgcctcac<br>cactgacatgcctggtgctgattaccactgcgctaagttattgggtttgtctccatccgttaagagagttatgatgta<br>ccaattgggttgctacggtggtggtactgttttaagaattgctaaggatattgctgaaaacaacaagggtgccaga<br>gtcttagctgtctgctgtgacattatggcttgtttattcagaggtccatctgaatccgacttggaattgttggttggtca<br>agctatcttcggtgacggtgctgctgccgttattgttggtgctgaaccagacgaatccgttggtgaaagaccaatt<br>ttgaattggtttccaccggtcaaactattttgccaaattccgaaggtaccatcggtggtcatatcagagaagccggt<br>ttgatcttcgacttacataaggatgtcccaatgttgatctctaacaacattgaaaagtgtttgatcgaagcttttaccc<br>caattggtatttctgactggaactctatcttctggattacccatcctggtggtaaggctattttggataaggtcgagga<br>aaaattgcacttgaagtctgacaagttcgttgactctagacacgtcttgtccgaacatggtaatatgtcctcttccac<br>cgttttattcgttatggatgagttgagaaagagatccttagaagaaggtaagtccaccaccggtgatggttttgagt<br>ggggtgttttgttcggtttcggtccaggtttgaccgtcgaaagagttgttgttagatctgtcccaattaagtacgcag<br>ccacaagcggttctacgggctccacgggctctaccggcagtgggagggagcactgggtcaacgggatcaacag<br>gtagtggaagatcacacatggttgccgtcaagcacttgatcgttttgaagttcaaggatgaaatcactgaagctca<br>aaaggaagaattcttcaaaacctacgtcaacttagtcaatattattccagccatgaaggacgtctattggggtaag<br>gacgttactcaaaagaataaggaggaaggttatactcatatcgttgaggtcactttcgaatctgttgagactattca<br>agactacatcatccacccagcccacgttggtttcggtgatgtttatcgttccttctgggaaaaattgttgatcttcgac<br>tacacccctagaaagggtaactcgagagcttttgattaa |
| SEQ ID NO: 80<br>Fusion tetraketide<br>synthase-olivetolic<br>acid cyclase (TKS-<br>OAC) | MNHLRAEGPASVLAIGTANPENILLQDEFPDYYFRVTKSEHMTQLKEK<br>FRKICDKSMIRKRNCFLNEEHLKQNPRLVEHEMQTLDARQDMLVVEV<br>PKLGKDACAKAIKEWGQPKSKITHLIFTSASTTDMPGADYHCAKLLGL<br>SPSVKRVMMYQLGCYGGGTVLRIAKDIAENNKGARVLAVCCDIMACL<br>FRGPSESDLELLVGQAIFGDGAAAVIVGAEPDESVGERPIFELVSTGQTI<br>LPNSEGTIGGHIREAGLIFDLHKDVPMLISNNIEKCLIEAFTPIGISDWNSI<br>FWITHPGGKAILDKVEEKLHLKSDKFVDSRHVLSEHGNMSSSTVLFVM<br>DELRKRSLEEGKSTTGDGFEWGVLFGFGPGLTVERVVVRSVPIKYAAT<br>SGSTGSTGSTGSSGRSTGSTGSGRSHMVAVKHLIVLKFKDEITEAQK<br>EEFFKTYVNLVNIIPAMKDVYWGKDVTQKNKEEGYTHIVEVTFESVET<br>IQDYIIHPAHVGFGDVYRSFWEKLLIFDYTPRKGNSRAFD* |
| SEQ ID NO: 81<br>Artificial geranyl<br>pyrophosphate<br>olivetolic acid<br>geranyltransferase<br>(GOT) nucleotide<br>sequence | atgggattgtccagcgtgtgcaccttctcattccaaaccaactaccatacacttctcaatccgcacaataataaccc<br>gaaaaccagcttattatgttatagacacccgaagacgcccattaagtacagttataacaactttcctagcaagcatt<br>gctctactaaaagttttcatctgcaaaacaagtgctctgagtccttgagtatagcaaagaatagcattagagctgca<br>acgacaaatcaaaccgagccgccggagtctgataaccatagtgtggcgaccaagatactaaattttggcaaagc<br>gtgttgaagctacaacgaccttatactattatcgcgtttacgagttgtgcatgtgggctgttcgggaaagagctctt<br>gcacaataccaacttaatcagttggagtttgatgttcaaagcattttttttttctcgtcgctatcttatgtatcgcgtcat<br>ttaccacgaccataaatcaatatcgatctgcatatcgatcgtatcaataagcccgacctcccactggcctcaggt<br>gaaatttccgttaacacggcgtggattatgagtataatcgtagcactatttggacttattataaccatcaaatgaag<br>ggcggtcctctatacatttttggatattgttttgggattttttggaggtatagtctattccgtccccccattcagatggaa<br>acaaaaccgtccaccgctttccttttaaatttcttggcacatatcatcacaaacttcacgttttactatgccagccga<br>gccgcactgggactcccgttcgagttgcgtccgtcattcaccttcctttttagcttttatgaaatctatgggaagcgct |

TABLE 1-continued

Amino acid and nucleotide sequences of the disclosure

| SEQ ID | SEQUENCE |
|---|---|
| | ttagctttaattaaggacgcgagcgacgtggaaggggacacgaaattcggtataagcacgctggcttcaaaatat<br>ggaagtcgtaatctcactctattttgttctgggattgtactcctaagttacgtagctgcgatactcgcaggcattatat<br>ggccacaagctttcaactccaacgtaatgttgctatcacatgcaatcttggccttctggctcatccttcaaactagag<br>attttgcactaacgaactacgatccagaagcgggtcgtcgattttacgaatttatgtggaaactgtactatgctgagt<br>acctcgtctatgtgttcata |
| SEQ ID NO: 82<br>geranyl<br>pyrophosphate<br>olivetolic acid<br>geranyltransferase<br>(GOT) (CsPT1)<br>Cannabis sativa<br>395 aa<br>WO 2011/017798 | MGLSSVCTFSFQTNYHTLLNPHNNNPKTSLLCYRHPKTPIKYSYNNFPS<br>KHCSTKSFHLQNKCSESLSIAKNSIRAATTNQTEPPESDNHSVATKILNF<br>GKACWKLQRPYTIIAFTSCACGLFGKELLHNTNLISWSLMFKAFFFLVA<br>ILCIASFTTTINQIYDLHIDRINKPDLPLASGEISVNTAWIMSIIVALFGLII<br>TIKMKGGPLYIFGYCFGIFGGIVYSVPPFRWKQNPSTAFLLNFLAHIITN<br>FTFYYASRAALGLPFELRPSFTFLLAFMKSMGSALALIKDASDVEGDTK<br>FGISTLASKYGSRNLTLFCSGIVLLSYVAAILAGIIWPQAFNSNVMLLSH<br>AILAFWLILQTRDFALTNYDPEAGRRFYEFMWKLYYAEYLVYVFI |
| SEQ ID NO: 83<br>Artificial aromatic<br>prenyltransferase<br>(NphB-ScCO)<br>nucleotide sequence | atgtctgaggcggcagacgtagagagagtatacgctgctatggaggaagcggctggattattgggggtggctt<br>gtgccagagacaagatatatccgttactgtctactttccaggacactcttgtagaaggagggagtgtggtggtgttt<br>agtatggcatcaggccgtcattcaacagagctagatttcagtatatctgtgccaacaagtcacggtgatccatacg<br>caaccgtagtcgagaagggtcttttcccggcaacagggcatcctgtagatgattgcttgccgacacacagaag<br>cacctgcccgtctccatgttcgcaatcgatggtgaggtgaccggaggattaaaaagacttacgcgtttcttcccga<br>ctgacaatatgccaggagttgccgagttgagtgcaataccatccatgccgccagcagtcgccggagaacgccga<br>attgttcgccgttacggcttggacaaagtccaaatgactagtatggactataaaaagaggcaggtgaatctatatt<br>tcagcgaacttctgcccaaaccttggaggcggagagcgttttagcccttgttagggagttagggctacacgtcc<br>cgaatgagttgggttgaaattttgtaagcgtagctttcagtatatccgacgctgaactgggaaactggaaagatt<br>gacaggctatgctttgcagtgatttctaatgaccctacgcttgtaccttcctcagacgagggcgacatcgaaaatt<br>ccacaactatgccacaaaagctccgtatgcctacgtcggcgaaaaacgtactctagtatacggtttgactctgagt<br>cccaaggaagagtattacaagctaggagcgtactatcatatcactgatgtgcaacgtggcttgctgaaagccttc<br>gactccttagaggac |
| SEQ ID NO: 84<br>Aromatic<br>prenyltransferase<br>NphB-ScCO<br>(Streptomyces sp.) | MSEAADVERVYAAMEEAAGLLGVACARDKIYPLLSTFQDTLVEGGSV<br>VVFSMASGRHSTELDFSISVPTSHGDPYATVVEKGLFPATGHPVDDLL<br>ADTQKHLPVSMFAIDGEVTGGFKKTYAFFPTDNMPGVAELSAIPSMPP<br>AVAENAELFARYGLDKVQMTSMDYKKRQVNLYFSELSAQTLEAESVL<br>ALVRELGLHVPNELGLKFCKRSFSVYPTLNWETGKIDRLCFAVISNDPT<br>LVPSSDEGDIEKFHNYATKAPYAYVGEKRTLVYGLTLSPKEEYYKLGA<br>YYHITDVQRGLLKAFDSLED |
| SEQ ID NO: 85<br>Artificial Tetrahydro<br>cannabinolic acid<br>synthase (THCAS)<br>nucleotide sequence | atgaactgttccgcgtttagtttctggttcgtgtgcaagatcatcttcttttttctaagcttcaacattcaaatcagcatc<br>gcgaatcctcaggagaacttcctgaagtgtttctcagaatacataccaaataatcccgccaatcctaaatttatatat<br>acccaacatgatcagctatacatgagtgtattgaactctacgattcagaatctaagattcacatctgatacaacgcc<br>gaaacctctagtaatcgtgacaccgtctaatgtctcccatattcaagcttctatcttgctcaaagaaagtcggtctt<br>caaataaggacacgttctggcgggcatgacgccgagggcatgtcatatatcagccaagtaccatttgtagtcgtg<br>gatttaagaaacatgcattctataaaaatcgacgttcactcccaaacgggcatgggtggaagctggagcgacactg<br>ggggaggtgtactactggatcaatgaaaagaacgaaaatttttccttccccggaggatattgtccgacagttggg<br>gtgggggccacttctctggcggcgggtacggcgctctgatgcgtaattatggactggccgcagataacataat<br>cgacgcgcatttggtgaacgttgacgggaaggtttggataggaagtctatgggagaggacctattctgggcaat<br>tagaggcggaggaggagagaattttggtattattgctgcatggaagattaaattggttgcggtgccgagtaaaag<br>taccatcttttccgtcaagaaaaacatggagattcacggactagttaagctgtttaataaatggcaaaacatcgcct<br>ataagtacgacaagattttggttctgatgacgcatttcataactaagaataaactgataatcacggcaagaataag<br>accactgtgcacggttattttagttcaatattccatggcggcgttgactccccttgtcgatttgatgaataagagcttcc<br>ctgaattgggtatcaagaagacagactgcaaagaattctcctggattgatacgactatcttctattcagggtcgtg<br>aatttcaacactgcgaatttcaaaaggagatattgttagaccgttccgcgggaaaaaaaactgcgttttctattaa<br>actagattatgtgaaaaaaccgattcctgagacagccatggttaagattcttgaaaaattgtatgaagaggatgtcg<br>gggtcggtatgtacgtccttttaccccttacggaggaatcatggaagaaatatccgaatctgcaattcctttcccgcat<br>cgtgccggtattatgatgagctatggtacaccgctagctgggagaagcaggaagataacgagaagcatatcca<br>ttgggtgaggtctgtgtataattttacaacaccatacgtcagtcaaaacccctagattggcctatcttaactatcgtgat<br>ctggacttgggaaaaacaaatccagaatccccaaataactacactcaagcccgtatatggggcgagaagtactt<br>cggcaaaaatttcaatagactggtcaaagttaagacgaaagcagaccctaataatttcttccgtaacgaacaatca<br>attccccgcttccgccacaccatcac |
| SEQ ID NO: 86<br>Tetrahydro<br>cannabinolic acid<br>synthase (THCAS)<br>Cannabis sativa | MNCSAFSFWFVCKIIFFFLSFNIQISIANPQENFLKCFSEYIPNNPANPKFI<br>YTQHDQLYMSVLNSTIQNLRFTSDTTPKPLVIVTPSNVSHIQASILCSKK<br>VGLQIRTRSCiGHDAEGMSYISQVPFVVVDLRNMHSIKIDVHSQTAWVE<br>AGATLGEVYYWINEKNENFSFPGGYCPTVGVGGHFSGGGYGALMRN<br>YGLAADNIIDAHLVNVDGKVLDRKSMGEDLFWAIRGGGGENFGIIAA<br>WKIKLVAVPSKSTIFSVKKNMEIHGLVKLFNKWQNIAYKYDKDLVLM<br>THFITKNITDNHGKNKTTVHGYFSSIFHGGVDSLVDLMNKSFPELGIKK<br>TDCKEFSWIDTTIFYSGVVNFNTANFKKEILLDRSAGKKTAFSIKLDYV<br>KKPIPETAMVKILEKLYEEDVGVGMYVLYPYGGIMEEISESAIPFPHRA<br>GIMYELWYTASWEKQEDNEKHINWVRSVYNFTTPYVSQNPRLAYLN<br>YRDLDLGKTNPESPNNYTQARIWGEKYFGKNFNRLVKVKTKADPNNF<br>FRNEQSIPPLPPHHH |
| SEQ ID NO: 87<br>Artificial | atgaaatgttctactttcagttttggttcgtgtgtaagatcatcttttttcttttcagcttcaatatacagacaagtatc<br>gccaatccaagagaaaatttcttaaaatgttttttcacagtacatccctaataacgccactaacctgaaattagtgtacac |

TABLE 1-continued

Amino acid and nucleotide sequences of the disclosure

| SEQ ID | SEQUENCE |
|---|---|
| Cannabidiolic acid synthase (CBDAS) nucleotide sequence | ccaaaataatcctctttatatgtctgttttaaactccacgatccataatttaaggtttacatcagatacgacaccaaag cccttggtaatcgtgactcccagccacgtgagccacatacaggggaccatcctgtgctctaagaaagtaggcttg cagatcaggacaagatccggtggacacgacagtgagggaatgtcctatatttcacaagtcccccttcgttatagta gatctgaggaacatgaggtccattaagattgatgtgcactcacaaacggcttggggtttgaagctggagccacattg ggagaggtttattactgggtgaatggagaagaaacgattgtcattagcagcgggatattgtcccacggtgtgc gcaggtgggcatttcgggggaggagggtacggcccttttgatgagaaattacgggctagcggcagacaacatc atcgacgcccatctggtgaacgtgcatggaaaagtactggacagaaagtcaatgggcgaggacctgttttgggc tttgagaggggcggtgcagagtcatttggcatcatagttgcatggaaaatcagacttgttgccgtcccaaagtcc acaatgttctctgtgttaagaaaatcatggagatacacgaattggtgaaattagtgaataaatggcaaaacatagcgt acaagtacgacaaagacttactgctgatgacacactttatcacccgtaatattacagataatcagggtaagaacaa aaccgcgatccatacatattttcatccgtttttctaggcggtgtcgattcattagtagatctgatgaacaaatctttcc ccgaacttggtatcaaaaagactgattgcagacagttatcatggattgataacaataatttttctattctggtgtcgtaaa ttacgataccgataattttaataaggaaatactattagatcgtttccgctgggcagaatggtgcattcaagataaaact tgattatgtcaaaaagcccattccagagagtgtctttgtgcagatccttgagaagttgtatgaagaagacattggtg cagggatgtacgcgctatatccgtacggggtattatgacgagatttctgagagcgccataccattcccacaca gagcaggaattttatacgagttatggtatatctgctcatgggaaaaacaggaagacaacgagaagcacttaaact ggatacgtaatatctataattttatgaccccatacgtatcaaaaaatccgcgtcttgcgtaccttaactacagggacc tggacataggtataaacgacccaaaaaatcccaataattacacccaagctagaatctgggggagaagtatttcg gtaagaactttgaccgtttggtaaaagtcaaaactctggtcgatccgaacaatttcttccgtaacgagcaatccata cctccgctaccgagacatagacat |
| SEQ ID NO: 88 GenBank A6P6V9 Cannabidiolic acid synthase (CBDAS) *Cannabis sativa* | MKCSTFSFWFVCKIIFFFFSFNIQTSIANPRENFLKCFSQYIPNNATNLKL VYTQNNPLYMSVLNSTIHNLRFTSDTTPKPLVIVTPSHVSHIQGTILCSK KVGLQIRTRSGGHDSEGMSYISQVPFVIVDLRNMRSIKIDVHSQTAWV EAGATLGEVYYWVNEKNENLSLAAGYCPTVCAGGHFGGGYGPLMR NYGLAADNIIDAHLVNVHGKVLDRKSMGEDLFWALRGGGAESFGIIV AWKIRLVAVPKSTMFSVKKIMEIHELVKLVNKWQNIAYKYDKDLLLM THFITRNITDNQGKNKTAIHTYFSSVFLGGVDSLVDLMNKSFPELGIKK TDCRQLSWIDTIIFYSGVVNYDTDNFNKEILLDRSAGQNGAFKIKLDYV KKPIPESVFVQILEKLYEEDIGAGMYALYPYGGIMDEISESAIPFPHRAGI LYELWYICSWEKQEDNEKHLNWIRNIYNFMTPYVSKNPRLAYLNYRD LDIGINDPKNPNNYTQARIWGEKYFGKNFDRLVKVKTLVDPNNFFRNE QSIPPLPRHRH |
| SEQ ID NO: 89 Artificial acyl-activating enzyme (CsAAE1) nucleotide sequence | atgggaaaaaactacaaaagtctggactccgtcgtcgcgtcagacttcattgccctaggcataacatcagaggta gcggaaaccttacacggcagactagccgagattgtttgtaactacggggcggctactcccagacttggatcaa tatagccaatcacatattaagccccgatttgccgttttcccttcaccaaatgttgttctacggctgctataaggacttt ggaccagcgcccccccggtgattcctgatccggagaaagttaaatccacgaatctttgggcattactagaaaa acgtgcaaagaattcctaggagttaaatataaggacccatatctcctttcacactttcaagaattttcagttaga aacccagaggtttactggaggacagtattaatgatgagatgaagataagctttagtaaggatccggagtgtattc tgcgtagagatgacattaacaatcctgcggaagtgaatggctgcctggtgggtacctgaatagtgctaagaact gtttaaacgtcaactctaataaaaaattgaatgataacaatgattgtatggagagacgaaagggaacgatgacctacc attgaacaagctgactctagatcagctacgtaaacgtgtatggttggtcgggtacggcgctggaggagatgggatt agaaaaaggatgcgcaattgctatcgacatgcctatgcatgtggacgcggtagtcatttacttggccattgtccta gcgggttacgtcgtcgtttcaattgcagacagctttttctgcacccgaaatcagtacccgtctgcgtttgtctaaagct aaggcaatatttacccaagaccatataattagaggcaagaagcgtataccgttgtacagtaggggttgtagaggca aagtcacccatggctattgtgataccatgctctggctctaatataggagcggagcttagagatggtgacatctcct gggattactttcttgaacgtgctaaggagtttaaaaactgtgaatttactgcaagagagcagcccgtggatcata cacaaacatattgttctccagcggtactacgggagaacctaaagcaatacctggacacaagctacaccccttaa agcggccgctgacggatggtcccacctggatatcaggaagggtgacgtcatagtttggccgactaacctggga tggatgatgggcccttggctggtttacgctagctttctgaatggggccagcattgcattgtacaatggctcaccgc ttgtatcaggcttcgcgaagttcgtacaggacgccaaggtaacaatgctaggcgtagttccgtccatagttaggtc ttggaagagcacgaactgcgttagtggctacgattggagcactattcgttgtttcagctcttctggcgaggccagc aacgttgatgaatatttgtggttgatgggagagcgaactacaaacctgttattgagatgtgcggcggaactgag attggggggagcattctccgccggttcttttctacaagcccaaagtttatcctcttttagcagccagtgcatgggctgt acactatacattctggacaaaaatggttatccgatgccgaaaaacaagcccggcatcggagaactggccctagg acccgtgatgttcggcgctagtaagacgttgttgaatgggaatcaccacgacgttttatttaagggaatgccaactt tgaatggcgaagtacttcgtagacacggagacatctttgagttgacttcaaacggttactaccacgctcatggacg tgccgatgatacgatgaacattggggggaattaaaattctcatcatagaaatagaacgtgtgtgtaacgaagtcgat gatcgtgtattcgagactacagccgatcggtgtcccaccgttgggtggggggaccagaacaattggtaatcttttttgt tctgaaagactccaacgatacgaccatcgacctaaatcagctgaggctatccttttaatctgggcttgcagaaaaa gctaaatccttttattcaaagtcactagagttgttcctttatcttcattaccaagaactgcaacaaataaaataatgcgta gagttctaaggcagcagtttagtcatttcgaa |
| SEQ ID NO: 90 Acyl-activating enzyme (CsAAE1) *Cannabis sativa* | MGKNYKSLDSVVASDFIALGITSEVAETLHGRLAEIVCNYGAATPQTW INIANHILSPDLPFSLHQMLFYGCYKDFGPAPPAWIPDPEKVKSTNLGA LLEKRGKEFLGVKYKDPISSFSHFQEFSVRNPEVYWRTVLMDEMKISFS KDPECILRRDDINNPGGSEWLPGGYLNSAKNCLNVSNKKLNDTMIV WRDEGNDDLPLNKLTLDQLRKRVWLVGYALEEMGLEKGCAIAIDMP MHVDAVVIYLAIVLAGYVVVSIADSFSAPEISTRLRLSKAKAIFTQDHII RGKKRIPLYSRVVEAKSPMAIVIPCSGSNIGAELRDGDISWDYFLERAK EFKNCEFTAREQPVDAYTNILFSSGTTGEPKAIPWTQATPLKAADGW SHLDIRKGDVIWPTNLGWMMGPWLVYASLLNGASIALYNGSPLVSG FAKFVQDAKVTMLGVVPSIVRSWKSTNCVSGYDWSTIRCFSSSGEASN VDEYLWLMGRANYKPVIEMCGGTEIGGAFSAGSFLQAQSLSSFSSQCM GCTLYILDKNGYPMPKNKPGIGELALGPVMFGASKTLLNGNHHDVYF |

TABLE 1-continued

Amino acid and nucleotide sequences of the disclosure

| SEQ ID | SEQUENCE |
|---|---|
| | KGMPTLNGEVLRRHGDIFELTSNGYYHAHGRADDTMNIGGIKISSIEIE<br>RVCNEVDDRVFETTAIGVPPLGGGPEQLVIFFVLKDSNDTTIDLNQLRL<br>SFNLGLQKKLNPLFKVTRVVPLSSLPRTATNKIMRRVLRQQFSHFE |
| SEQ ID NO: 91<br>Artificial acyl-<br>activating enzyme<br>(CsAAE3) nucleotide<br>sequence | atggaaaagtctggttatggtagagatggtatctacaggtctttaagaccaccattgcatttgccaaacaacaaca<br>acttgtccatggtcagtttcttgttcagaaactcttcttcctacccacaaaaaccagccttgattgactctgaaactaa<br>tcaaatcttgtccttctcccacttcaaatccaccgttattaaggtttctcacggtttcttgaacttgggtatcaagaaga<br>atgactggttgatctacgctccaaactctattcatttcccagtttgcttttgggtattattgcttctggtgctattgcta<br>ctacttccaaaccattatacaccgtcagtgaattgtctaagcaagtcaaggattctaacccaaagttgattatcaccgtt<br>ccacaattattggaaaaggtcaagggtttcaacttgccaaccattttgattggtccagactcagaacaagaatcctc<br>ttcagataaggttatgaccttcaacgatttggttaacttgggtggttcttctggtctgaatttccaatcgttgatgactt<br>caagcaatctgatactgctgctttgttgtactcttctggtactactggtatgtctaaaggttggttgactcacaagaac<br>tttatcgcctcttctttgatggttaccatggaacaagacttggttggtgaaatggataacgttttcttgtgcttcttgcca<br>atgttccatgttttcggtttggccattattacctacgctcaattgcaaagaggtaacactgttatttccgccagattcga<br>tttggaaaagatgttgaaggacgtcgaaaagtatgttactcatttgtggtggcctccagttattttggctttgtctaaa<br>aactccatggttaagttcaacttgtcatccatcaagtacattggttcaggtgctgctccattgggtaaggatttgatg<br>gaagaatgttctaaatggccatacggtatagttgctcaaggttacggtatgactgaaacttgtggtatcgtttctatg<br>gaagatatcagaggtggtaagagaaattctggttcagctggtatgttggcttcaggtgttgaagctcaaatagtttc<br>tgttgataccttgaaaccattgccaccaaatcaatttgggtgaaatttgggttaagggtccaaatatgatgcaaggtt<br>acttcaacaatccacaagctaccaagttgaccattgataagaaaggttgggttcatactggtgacttgggttacttt<br>gatgaagatggtcacttgtactgggacagaatcaaagaattgattaagtacaagggttttcaagtcgctccagctg<br>aattggaaggtttgttggtttctctcatccagaaatattggatgcctggattccatttccagatgctgaagctggtgaag<br>ttccagttgcttattggagatcaccaaactcttcattgactgaaaacgacgtcaagaagttcattgctggtcaagttg<br>cttctttcaagagattgagaaaggtcaccttcatcaactctgttccaaaatctgcttccggtaagatcttgagaagag<br>aattgatccaaaaggtcagatccaatatg |
| SEQ ID NO: 92<br>Acyl-activating<br>enzyme (CsAAE3)<br>*Cannabis sativa* | MEKSGYGRDGIYRSLRPPLHLPNNNNLSMVSFLFRNSSSYPQKPALIDS<br>ETNQILSFSHFKSTVIKVSHGFLNLGIKKNDWLIYAPNSIHFPVCFLGIIA<br>SGAIATTSNPLYTVSELSKQVKDSNPKLIITVPQLLEKVKGFNLPTILIGP<br>DSEQESSSDKVMTFNDLVNLGGSSGSEFPIVDDFKQSDTAALLYSSGTT<br>GMSKGWLTHKNFIASSLMVTMEQDLVGEMDNVFLCFLPMFHVFGLAI<br>ITYAQLQRGNTVISARFDLEKMLKDVEKYVTHLWWPPVILALSKNSM<br>VKFNLSSIKYIGSGAAPLGKDLMEECSKWPYGIVAQGYGMTETCGIVS<br>MEDIRGGKRNSGSAGMLASGVEAQIVSVDTLKPLPPNQLGEIWVKGPN<br>MMQGYFNNPQATKLTIDKKGWVHTGDLGYFDEDGHLYWDRIKELIK<br>YKGFQVAPAELEGLLVSHPEILDAWIPFPDAEAGEVPVAYWRSPNSSL<br>TENDVKKFIAGQVASFKRLRKVTFINSVPKSASGKILRRELIQKVRSNM |
| SEQ ID NO: 93<br>Artificial<br>acetoacetyl-<br>CoA reductase<br>(PhaB) nucleotide<br>sequence | atgacgcagagaatcgcctatgtaacgggtgggatgggtgggataggaaccgccatatgtcagagactagcaa<br>aggacggattcagggttgtagccggttgcggtcctaatagtccaagaagagagaaatggttggaacagcaaaa<br>agctctaggatttgattttatagcatcagaagggaatgttgctgactgggattctacaaagacggcatttgacaaag<br>tgaaatctgaagtcgcgagtgcgatgtcctaattaacaacgccggcatcaccagagatgtggttttcaggaaga<br>tgactagggctgactgggacgccgtgatagacacaaatttgacgagctgttgttcaacgtcacaaagcaagtaattg<br>acggcatggcagatcgtgggtgggaaggatagtcaatatctccagcgtcaacggtcagaaaggccagttcgg<br>acagactaactactccacagcgaaggctggcttacacggattcacgatggccttggcccaagaggtggctacta<br>aaggggtgactgtgaacacagtgtcaccaggatacatccgcgacggatatggtcaaagctattagacaagatgtc<br>ctggacaagattgttgccactattcccgtaaagaggcttgggttaccagaagagatagcttcaatttgcgcttggct<br>atctagtgaggaatcagggttcagcactgggcggacttttcattaaacggtggattacacatgggaggatcc |
| SEQ ID NO: 94<br>Mutant acetoacetyl-<br>CoA reductase<br>(PhaB) | MTQRIAYVTGGMGGIGTAICQRLAKDGFRVVAGCGPNSPRREKWLEQ<br>QKALGFDFIASEGNVADWDSTKTAFDKVKSEVGEVDVLINNAGITRD<br>VVFRKMTRADWDAVIDTNLTSLFNVTKQVIDGMADRGWGRIVNISSV<br>NGGQKGQFGQTNYSTAKAGLHGFTMALAQEVATKGVTVNTVSPGYIA<br>TDMVKAIRQDVLDKIVATIPVKRLGLPEEIASICAWLSSEESGFSTGADF<br>SLNGGLHMGGS |
| SEQ ID NO: 95<br>Artificial<br>(R)-specific<br>enoyl-CoA hydratase<br>(PhaJ) | atgtctgcccagagtctggaagtcggtcaaaaagcaagactgtcaaaaagatttggggcggcagaggtagcgg<br>cgttcgcggcgctgtctgaggattttaatccactgcacttagatcctgcgttcgccgcgacaacagcattcgagag<br>gccatcgtgcacggcatgctacttgcctcttgttctcaggtctactgggtcaacagttacctgggaaaggaagc<br>atctatctgggacagtcattgtcttttaagctgcccgtcttcgtcggcgatgaggtgacagcagaagtagaagtca<br>cagcattgagggaagacaagcctattgcgacccttactactcgtattttactcagggcggagccttagcagtgac<br>aggagaagctgtagtaaaactaccaggatcc |
| SEQ ID NO: 96<br>Mutant (R)-specific<br>enoyl-CoA hydratase<br>(PhaJ) | MSAQSLEVGQKARLSKRFGAAEVAAFAALSEDFNPLHLDPAFAATTA<br>FERPIVHGMLLASLFSGLLGQQLPGKGSIYLGQSLSFKLPVFVGDEVTA<br>EVEVTALREDKPIATLTTRIFTQGGALAVTGEAVVKLPGS |
| SEQ ID NO: 97<br>Mutated acetyl-CoA<br>carboxylase (ACC1)<br>(S659A, S1157A) | MSEESLFESSPQKMEYEITNYSERHTELPGHFIGLNTVDKLEESPLRDFV<br>KSHGGHTVISKILIANNGIAAVKEIRSVRKWAYETFGDDRTVQFVAMA<br>TPEDLEANAEYIRMADQYIEVPGGTNNNNYANVDLIVDIAERADVDA<br>VWAGWGHASENPLLPEKLSQSKRKVIFIGPPGNAMRSLGDKISSTIVAQ<br>SAKVPCIPWSGTGVDTVHVDEKTGLVSVDDDIYQKGCCTSPEDGLQK<br>AKRIGFPVMIKASEGGGGKGIRQVEREEDFIALYHQAANEIPGSPIFIMK<br>LAGRARHLEVQLLADQYGTNISLFGRDCSVQRRHQKIIEEAPVTIAKAE<br>TFHEMEKAAVRLGKLVGYVSAGTVEYLYSHDDGKFYFLELNPRLQVE |

TABLE 1-continued

Amino acid and nucleotide sequences of the disclosure

| SEQ ID | SEQUENCE |
|---|---|
| | HPTTEMVSGVNLPAAQLQIAMGIPMHRISDIRTLYGMNPHSASEIDFEF<br>KTQDATKKQRRPIPKGHCTACRITSEDPNDGFKPSGGTLHELNFRSSSN<br>VWGYFSVGNNGNIHSFSDSQFGHIFAFGENRQASRKHMVVALKELSIR<br>GDFRTTVEYLIKLLETEDFEDNTIITTGWLDDLITHKMTAEKPDPTLAVI<br>CGAATKAFLASEEARHKYIESLQKGQVLSKDLLQTMFPVDFIHEGKRY<br>KFTVAKSGNDRYTLFINGSKCDIILRQLADGGLLIAIGGKSHTIYWKEE<br>VAATRLSVDSMTTLLEVENDPTQLRTPSPGKLVKFLVENGEHIIKGQPY<br>AEIEVMKMQMPLVSQENGIVQLLKQPGSTIVAGDIMAIMTLDDPSKVK<br>HALPFEGMLPDFGSPVIEGTKPAYKFKSLVSTLENILKGYDNQVIMNAS<br>LQQLIEVLRNPKLPYSEWKLHISALHSRLPAKLDEQMEELVARSLRRG<br>AVFPARQLSKLIDMAVKNPEYNPDKLLGAVVEPLADIAHKYSNGLEA<br>HEHSIFVHFLEEYYEVEKLFNGPNVREENIILKLRDENPKDLDKVALTV<br>LSHSKVSAKNNLILAILKHYQPLCKLSSKVSAIFSTPLQHIVELESKATA<br>KVALQAREILIQGALPSVKERTEQIEHILKSSVVKVAYGSSNPKRSEPDL<br>NILKDLIDSNYVVFDVLLQFLTHQDPVVTAAAAQVYIRRAYRAYTIGDI<br>RVHEGVTVPIVEWKFQLPSAAFSTFPTVKSKMGMNRAVSVADLSYVA<br>NSQSSPLREGILMAVDHLDDVDEILSQSLEVIPRHQSSSNGPAPDRSGSS<br>ASLSNVANVCVASTEGFESEEEILVRLREILDLNKQELINASIRRITFMF<br>GFKDGSYPKYYTFNGPNYNENETIRHIEPALAFQLELGRLSNFNIKPIFT<br>DNRNIHVYEAVSKTSPLDKRFFTRGIIRTGHIRDDISIQEYLTSEANRLM<br>SDILDNLEVTDTSNSDLNHIFINFIAVFDISPEDVEAAFGGFLERFGKRLL<br>RLRVSSAEIRIIIKDPQTGAPVPLRALINNVSGYVIKTEMYTEVKNAKGE<br>WVFKSLGKPGSMHLRPIATPYPVKEWLQPKRYKAHLMGTTYVYDFPE<br>LFRQASSSQWKNFSADVKLTDDFFISNELIEDENGELTEVEREPGANAI<br>GMVAFKITVKTPEYPRGRQFVVVANDITFKIGSFGPQEDEFFNKVTEYA<br>RKRGIPRIYLAANSGARIGMAEEIVPLFQVAWNDAANPDKGFQYLYLT<br>SEGMETLKKFDKENSVLTERTVINGEERFVIKTIIGSEDGLGVECLRGSG<br>LIAGATSRAYHDIFTITLVTCRSVGIGAYLVRLGQRAIQVEGQPIILTGA<br>PAINKMLGREVYTSNLQLGGTQIMYNNGVSHLTAVDDLAGVEKIVEW<br>MSYVPAKRNMPVPILETKDTWDRPVDFTPTNDETYDVRWMIEGRETE<br>SGFEYGLFDKGSFFETLSGWAKGVVVGRARLGGIPLGVIGVETRTVEN<br>LIPADPANPNSAETLIQEPGQVWHPNSAFKTAQAINDFNNGEQLPMMIL<br>ANWRGFSGGQRDMFNEVLKYGSFTVDALVDYKQPIIIYIPPTGELRGGS<br>WVVVDPTINADQMEMYADVNARAGVLEPQGMVGIKFRREKLLDTM<br>NRLDDKYRELRSQLSNKSLAPEVHQQISKQLADREREDLLPIYGQISLQF<br>ADLHDRSSRMVAKGVISKELEWTEARRFFFWRLRRRLNEEYLIKRLSH<br>QVGEASRLEKIARIRSWYPASVDHEDDRQVATWIEENYKTLDDKLKG<br>LKLESFAQDLAKKIRSDHDNAIDGLSEVIKMLSTDDKEKLLKTLK* |
| SEQ ID NO: 98<br>Truncated geranyl<br>pyrophosphate<br>olivetolic acid<br>geranyltransferase<br>CsGOTt75 | MAATTNQTEPPESDNHSVATKILNFGKACWKLQRPYTIIAFTSCACGLF<br>GKELLHNTNLISWSLMFKAFFFLVAILCIASFTTTINQIYDLHIDRINKPD<br>LPLASGEISVNTAWIMSIIVALFGLIITIKMKGGPLYIFGYCFGIFGGIVYS<br>VPPFRWKQNPSTAFLLNFLAHIITNFTFYYASRAALGLPFELRPSFTFLL<br>AFMKSMGSALALIKDASDVEGDTKFGISTLASKYGSRNLTLFCSGIVLL<br>SYVAAILAGIIWPQAFNSNVMLLSHAILAFWLILQTRDFALTNYDPEAG<br>RRFYEFMWKLYYAEYLVYVFI* |
| SEQ ID NO: 99<br>Truncated geranyl<br>pyrophosphate<br>olivetolic acid<br>geranyltransferase<br>CsGOTt33 | MSHPKTPIKYSYNNFPSKHCSTKSFHLQNKCSESLSIAKNSIRAATTNQT<br>EPPESDNHSVATKILNFGKACWKLQRPYTIIAFTSCACGLFGKELLHNT<br>NLISWSLMFKAFFFLVAILCIASFTTTTINQIYDLHIDRINKPDLPLASGEIS<br>VNTAWIMSIIVALFGLIITIKMKGGPLYIFGYCFGIFGGIVYSVPPFRWK<br>QNPSTAFLLNFLAHHTNFTFYYASRAALGLPFELRPSFTFLLAFMKSMG<br>SALALIKDASDVEGDTKFGISTLASKYGSRNLTLFCSGIVLLSYVAAILA<br>GIIWPQAFNSNVMLLSHAILAFWLILQTRDFALTNYDPEAGRRFYEFM<br>WKLYYAEYLVYVFI* |
| SEQ ID NO: 100<br>Truncated geranyl<br>pyrophosphate<br>olivetolic acid<br>geranyltransferase<br>CsPT4t | MSAGSDQIEGSPHHESDNSIATKILNFGHTCWKLQRPYVVKGMISIACG<br>LFGRELFNNRHLFSWGLMWKAFFALVPILSFNFFAAIMNQIYDVDIDRI<br>NKPDLPLVSGEMSIETAWILSIIVALTGLIVTIKLKSAPLFVFIYIFGIFAG<br>FAYSVPPIRWKQYPFTNFLITISSHVGLAFTSYSATTSALGLPFVWRPAF<br>SFIIAFMTVMGMTIAFAKDISDIEGDAKYGVSTVATKLGARNMTFVVS<br>GVLLLNYLVSISIGIIWPQVFKSNIMILSHAILAFCLIFQTRELALANYAS<br>APSRQFFEFIWLLYYAEYFVYVFI* |
| SEQ ID NO: 101<br>Truncated geranyl<br>pyrophosphate<br>olivetolic acid<br>geranyltransferase<br>CsPT7t | MSTDTANQTEPPESNTKYSVVTKILSFGHTCWKLQRPYTFIGVISCACG<br>LFGRELFHNTNLLSWSLMLKAFSSLMVILSVNLCTNIINQITDLDIDRIN<br>KPDLPLASGEMSIETAWIMSIIVALTGLILTIKLNCGPLFISLYCVSILVG<br>ALYSVPPFRWKQNPNTAFSSYFMGLVIVNFTCYYASRAAFGLPFEMSP<br>PFTFILAFVKSMGSALFLCKDVSDIEGDSKHGISTLATRYGAKNITFLCS<br>GIVLLTYVSAILAAIIWPQAFKSNVMLLSHATLAFWLIFQTREFALTNY<br>NPEAGRKFYEFMWKLHYAEYLVYVFI* |
| SEQ ID NO: 102<br>Truncated geranyl<br>pyrophosphate<br>olivetolic acid | MDRPPESGNLSALTNVKDFVSVCWEYVRPYTAKGVIICSSCLFGRELL<br>ENPNLFSWPLIFRALLGMLAILGSCFYTAGINQIFDMDIDRINKPDLPLV<br>SGRISVESAWLLTLSPAIIGFILILKLNSGPLLTSLYCLAILSGTIYSVPPFR<br>WKKNPITAFLCILMIHAGLNFSVYYASRAALGLAFVWSPSFSFITAFITF |

TABLE 1-continued

Amino acid and nucleotide sequences of the disclosure

| SEQ ID | SEQUENCE |
|---|---|
| geranyltransferase H1PT1Lt | MTLTLASSKDLSDINGDRKFGVETFATKLGAKNITLLGTGLLLLNYVA AISTAIIWPKAFKSNIMLLSHAILAFSLFFQARELDRTNYTPEACKSFYEF IWILFSAEYVVYLFI* |
| SEQ ID NO: 103 Truncated geranyl pyrophosphate olivetolic acid geranyltransferase H1PT2t | MGHLPRPNSLTAWSHQSEFPSTIVTKGSNFGHASWKFVRPIPFVAVSIIC TSLFGAELLKNPNLFSWQLMFDAFQGLVVILLYHIYINGLNQIYDLESD RINKPDLPLAAEEMSVKSAWFLTIFSAVASLLLMIKLKCGLFLTCMYCC YLVIGAMYSVPPFRWKMNTFTSTLWNFSEIGIGINFLINYASRATLGLPF QWRPPFTFIIGFVSTLSIILSILKDVPDVEGDKKVGMSTLPVIFGARTIVL VGSGFFLLNYVAAIGVAIMWPQAFKGYIMIPAHAIFASALIFKTWLLDK ANYAKEASDSYYHFLWFLMIAEYILYPFIST* |
| SEQ ID NO: 104 Truncated tetrahydrocannabinolic acid synthase THCASt28 | MNFLKCFSEYIPNNPANPKFIYTQHDQLYMSVLNSTIQNLRFTSDTTPK PLVIVTPSNVSHIQASILCSKKVGLQIRTRSGGHDAEGMSYISQVPFVVV DLRNMHSIKIDVHSQTAWVEAGATLGEVYYWINEKNENFSFPGGYCP TVGVGGHFSGGGYGALMRNYGLAADNIIDAHLVNVDGKVLDRKSMG EDLFWAIRGGGGENFGIIAAWKIKLVAVPSKSTIFSVKKNMEIHGLVKL FNKWQNIAYKYDKDLVLMTHFITKNITDNHGKNKTTVHGYFSSIFHGG VDSLVDLMNKSFPELGIKKTDCKEFSWIDTTIFYSGVVNFNTANPKKEI LLDRSAGKKTAFSIKLDYVKKPIPETAMVKILEKLYEEDVGVGMYVLY PYGGIMEEISESAIPFPHRAGIMYELWYTASWEKQEDNEKHINWVRSV YNFTTPYVSQNPRLAYLNYRDLDLGKTNPESPNNYTQARIWGEKYFG KNFNRLVKVKTKADPNNFFRNEQSIPPLPPHHH* |
| SEQ ID NO: 105 Truncated cannabidiolic acid synthase CBDASt28* | MNPRENFLKCFSQYIPNNATNLKLVYTQNNPLYMSVLNSTIHNLRFTS DTTPKPLVIVTPSHVSHIQGTILCSKKVGLQIRTRSGGHDSEGMSYISQV PFVIVDLRNMRSIKIDVHSQTAWVEAGATLGEVYYWVNEKNENLSLA AGYCPTVCAGGHFGGGGYGPLMRNYGLAADNIIDAHLVNVHGKVLD RKSMGEDLFWALRGGGAESFGIIVAWKIRLVAVPKSTMFSVKKIMEIH ELVKLVNKWQNIAYKYDKDLLLMTHFITRNITDNQGKNKTAIHTYFSS VFLGGVDSLVDLMNKSFPELGIKKTDCRQLSWIDTIIFYSGVVNYDTD NFNKEILLDRSAGQNGAFKIKLDYVKKPIPESVFVQILEKLYEEDIGAG MYALYPYGGIMDEISESAIPFPHRAGILYELWYICSWEKQEDNEKHLN WIRNIYNFMTPYVSKNPRLAYLNYRDLDIGINDPKNPNNYTQARIWGE KYFGKNFDRLVKVKTLVDPNNFFRNEQSIPPLPRHRH* |
| SEQ ID NO: 106 Mutated fatty acid synthase (FAS1, I306A, R1834K) | MDAYSTRPLTLSHGSLEHVLLVPTASFFIASQLQEQFNKILPEPTEGFAA DDEPTTPAELVGKFLGYVSSLVEPSKVGQFDQVLNLCLTEFENCYLEG NDIHALAAKLLQENDTTLVKTKELIKNYITARIMAKRPFDKKSNSALFR AVGEGNAQLVAIFGGQGNTDDYFEELRDLYQTYHVLVGDLIKFSAETL SELIRTTLDAEKVFTQGLNILEWLENPSNTPDKDYLLSIPISCPLIGVIQL AHYVVTAKLLGFTPGELRSYLKGATGHSOGLVTAVAIAETDSWESFFV SVRKAITVLFFGGVRCYEAYPNTSLPPSILEDSLENNEGVPSPMLSISNL TQEQVQDYVNKTNSHLPAGKQVEISLVNGAKNLVVSGPPQSLYGLNL TLRKAKAPSGLDQSRIPFSERKLKFSNRFLPVASPFHSHLLVPASDLINK DLVKNNVSFNAKDIQIPVYDTFDGSDLRVLSGSISERIVDCIIRLPVKWE TTTQFKATHILDFGPGGASGLGVLTHRNKDGTGVRVIVAGTLDINPDD DYGFKQEIFDVTSNGLKKNPNWLEEYHPKLIKNKSGKIFVETKFSKLIG RPPLLVPGMTPCTVSPDFVAATTNAGYTIELAGGGYFSAAGMTAAIDS VVSQIEKGSTFGINLIYVNPFMLQWGIPLIKELRSKGYPIOFLTIGAGVPS LEVASEYIETLGLKYLGLKPGSIDAISQVINIAKAHPNFPIALQWTGGRG GGHHSFEDAHTPMLQMYSKIRRHPNIMLIFGSGFGSADDTYPYLTGEW STKFDYPPMPFDGFLFGSRVMIAKEVKTSPDAKKCIAACTGVPDDKWE QTYKKPTGGIVTVRSEMGEPIHKIATRGVMLWKEFDETIFNLPKNKLV PTLEAKRDYIISRLNADFQKPWFATVNGQARDLATMTYEEVAKRLVE LMFIRSTNSWFDVTWRTFTGDFLRRVEERFTKSKTLSLIQSYSLLDKPD EAIEKVFNAYPAAREQFLNAQDIDHFLSMCQNPMQKPVPFVPVLDRRF EIFFFKKDSLWQSEHLEAVVDQDVQRTCILHGPVAAQFTKVIDEPIKSIM DGIHDGHIKKLLHQYYGDDESKIPAVEYFGGESPVDVQSOVDSSSVSE DSAVFKATSSTDEESWFKALAGSEINWRHASFLCSFITQDKMFVSNPIR KVFKPSQGMVVEISNGNTSSKTVVTLSEPVQGELKPTVILKLLKENIIQ MEMIENRTMDGKPVSLPLLYNFNPDNGFAPISEVMEDRNQPIKEMYW KLWIDEPFNLDFDPRDVIKGKDFEITAKEVYDFTHAVGNNCEDFVSRP DRTMLAPMDFAIVVGWRAIIKAIFPNTVDGDLLKLVHLSNGYKMIPGA KPLQVGDVVSTTAVIESVVNQPTGKIVDVVGTLSRNGKPVMEVTSSFF YRGNYTDFENTFOKTVEPVYQMHIKTSKDIAVLRSKEWFQLDDEDFD LLNKTLTFETETEVTFKNANIFSSVKCFGPIKVELPTKETVEIGIVDYEA GASHGNPVVDFLKRNGSTLEQKVNLENPIPIAVLDSYTPSTNEPYARVS GDLNPIHVSRHFASYANLPGTITHGMFSSASVRALIENWAADSVSSRVR GYTCQFVDMVLPNTALKTSIQHVGMINGRKLIKFETRNEDDVVVLTGE AEIEQPVTTFVFTGQGSQEQGMGMDLYKTSKAAQDVWRADNHFKD TYGFSILDIVINNPVNLTIHFGGEKGKRIRENYSAMIFETIVDGKLKTEKI FKEEINEHSTSYTFRSEKGLLSATQFTQPALTLMEKAAFEDLKSKGLIPA DATFAGHSLGEYAALASLADVMSIESLVEVVFYFGMTMQVAVPRDEL GRSNYGMIAINPGRVAASFSQEALQYVVERVGKRTGWLVEIVNYNVE NQQYVAAGDLRALDTVTNVLNFIKLQKIDIIELQKSLSLEEVEGHLFEII |

TABLE 1-continued

Amino acid and nucleotide sequences of the disclosure

| SEQ ID | SEQUENCE |
|---|---|
| | DEASKKSAVKPRPLKLERGFACIPLVGISVPFHSTYLMNGVKPFKSFLK<br>KNIIKENVKVARLAGKYIPNLTAKPFQVTKEYFQDVYDLTGSEPIKEIID<br>NWEKYEQS* |
| SEQ ID NO: 107<br>Mutated fatty acid<br>synthase (FAS2,<br>G1250S) | MKPEVEQELAHILLTELLAYQFASPVRWIETQDVFLKDFNTERVVEIGP<br>SPTLAGMAQRTLKNKYESYDAALSLHREILCYSKDAKEIYYTPDPSEL<br>AAKEEPAKEEAPAPTPAASAPAPAAAAPAPVAAAAPAAAAAEIADEPV<br>KASLLLHVLVAHKLKKSLDSIPMSKTIKDLVGGKSTVQNEILGDLGKE<br>FGTTPEKPEETPLEELAETFQDTFSGALGKQSSSLLSRLISSKMPGGFTIT<br>VARKYLQTRWGLPSGRQDGVLLVALSNEPAARLGSEADAKAFLDSM<br>AQKYASIVGVDLSSAASASGAAGAGAAAGAAMIDAGALEEITKDHKV<br>LARQQLQVLARYLKMDLDNGERKFLKEKDTVAELQAQLDYLNAELG<br>EFFVNGVATSFSRKKARTFDSSWNWAKQSLLSLYFEIIHGVLKNVDRE<br>VVSEAINIMNRSNDALIKFMEYHISNTDETKGENYQLVKTLGEQLIENC<br>KQVLDVDPVYKDVAKPTGPKTAIDKNGNITYSEEPREKVRKLSQYVQ<br>EMALGGPITKESQPTIEEDLTRVYKAISAQADKQDISSSTRVEFEKLYSD<br>LMKFLESSKEIDPSQTTQLAGMDVEDALDKDSTKEVASLPNKSTISKTV<br>SSTIPRETIPPFLHLRKKTPAGDWKYDRQLSSLFLDGLEKAAFNGVTFKD<br>KYVLITGAGKGSIGAEVLQGLLQGGAKVVVTTSRFSKQVTDYYQSIYA<br>KYGAKGSTLIVVPFNQGSKQDVEALIEFIYDTEKNGGLGWDLDAIIPFA<br>AIPEQGIELEHIDSKSEFAHRIMLTNILRMMGCVKKQKSARGIETRPAQ<br>VILPMSPNHGTFGGDMYSESKLSLETLFNRWHSESWANQLTVCGAII<br>GWTRGTGLMSANNIIAEGIEKMGVRTFSQKEMAFNLLGLLTPEVVELC<br>QKSPVMADLNGGLQFVPELKEFTAKLRKELVETSEVRKAVSIETALEH<br>KVVNGNSADAAYAQVEIQPRANIQLDFPELKPYKQVKQIAPAELEGLL<br>DLERVIVVTGFAEVGPWGSARTRWEMEAFGEFSLEGCVEMAWIMGFI<br>SYHNGNLKGRPYTGWVDSKTKEPVDDKDVKAKYETSILEHSGIRLIEP<br>ELFNGYNPEKKEMIQEVIVEEDLEPPEASKETAEQFKHQHGDKVDIFEI<br>PETGEYSVKLLKGATLYIPKALRFDRLVAGQIPTGWNAKTYGISDDIIS<br>QVDPITLFVLSVVEAFIASGITDPYEMYKYVHVSEVGNCSGSSMGGV<br>SALRGMFKDRFKDEPVQNDILQESFINTMSAWVNMLLISSSGPIKTPVG<br>ACATSVESVDIGVETILSGKARICIVGGYDDFQEEGSFEFGNMKATSNT<br>LEEFEHGRTPAEMSRPATTTRNGFMEAQGAGIQIIMQADLALKMGVPI<br>YGIVAMAATATDKIGRSVPAPGKGILTTAREHHSSVKYASPNLNMKYR<br>KRQLVTREAQIKDWVENELEALKLEAEEIPSEDQNEFLLERTREIHNEA<br>ESQLRAAQQQWGNDFYKRDPRIAPLRGALATYGLTIDDLGVASFHGTS<br>TKANDKNESATINEMMKHLGRSEGNPVIGVFQKFLTGHPKGAAGAW<br>MMNGALQILNSGIIPGNRNADNVDKILEQFEYVLYPSKTLKTDGVRAV<br>SITSFGFGQKGGQAIVVHPDYLYGAITEDRYNEYVAKVSAREKSAYKF<br>FHNGMIYNKLFVSKEHAPYTDELEEDVYLDPLARVSKDKKSGSLTFNS<br>KNIQSKDSYINANTIETAKMIENMTKEKVSNGGVGVDVELITSINVEND<br>TFIERNFTPQEIEYCSAQPSVQSSFAGTWSAKEAVFKSLGVKSLGGGAA<br>LKDIEIVRVNKNAPAVELHGNAKKAAEEAGVTDVKVSISHDDLQAVA<br>VAVSTKK* |
| SEQ ID NO: 108<br>MBPtag | MKIEEGKLVIWINGDKGYNGLAEVGKKFEKDTGIKVTVEHPDKLEEKF<br>PQVAATGDGPDIIFWAHDRFGGYAQSGLLAEITPDKAFQDKLYPFTWD<br>AVRYNGKLIAYPIAVEALSLIYNKDLLPNPPKTWEEIPALDKELKAGK<br>SALMFNLQEPYFTWPLIAADGGYAFKYENGKYDIKDVGVDNAGAKA<br>GLTFLVDLIKNKHMNADTDYSIAEAAFNKGETAMTINGPWAWSNIDT<br>SKVNYGVTVLPTFKGQPSKPFVGVLSAGINAASPNKELAKEFLENYLL<br>TDEGLEAVNKDKPLGAVALKSYEEELAKDPRIAATMENAQKGEIMPNI<br>PQMSAFWYAVRTAVINAASGRQTVDEALKDAQTRITK |
| SEQ ID NO: 109<br>ProA tag | MIFDGTTMSIAIGLLSTLGIGAEA |
| SEQ ID NO: 110<br>Geranyl<br>pyrophosphate<br>olivetolic acid<br>geranyltransferase<br>CsPT4<br>Cannibis sativa | MGLSLVCTFSFQTNYHTLLNPHNKNPKNSLLSYQHPKTPIIKSSYDNFP<br>SKYCLTKNFHLLGLNSHNRISSQSRSIRAGSDQIEGSPHHESDNSIATKIL<br>NFGHTCWKLQRPYVVKGMISIACGLFGRELFNNRHLFSWGLMWKAFF<br>ALVPILSFNFFAAIMNQIYDVDIDRINKPDLPLVSGEMSIETAWILSIIVA<br>LTGLIVTIKLKSAPLFVFIYIFGIFAGFAYSVPPIRWKQYPFTNFLITISSH<br>VGLAFTSYSATTSALGLPFVWRPAFSFIIAFMTVMGMTIAFAKDISDIEG<br>DAKYGVSTVATKLGARNMTFVVSGVLLLNYLVSISIGIIWPQVFKSNIM<br>ILSHAILAFCLIFQTRELALANYASAPSRQFFEFIWLLYYAEYFVYVFT* |
| SEQ ID NO: 111<br>Artificial geranyl<br>pyrophosphate<br>olivetolic acid<br>geranyltransferase<br>CsPT4 nucleotide<br>sequence | atgggtttatctttggtctgcaccttctcctttcaaactaactaccacactttattgaatccacataataagaatcctaa<br>gaactctttattgtcctaccaacacccaaagactcctattatcaagtcctcttacgataacttcccatctaagtactgtt<br>tgactaagaatttccatttgttgggtttgaattctcacaacagaatttcctcccaatcccgttctattagagccggttct<br>gatcaaatcgaaggttcccctcatcatgagtccgataactccattgctactaaaattttaaatttcggtcatacttgttg<br>gaagttgcaactgtcctacgttcgtcaaggtatgatctctattgctgttgtggtttgttcggtagagaattgtttaacaac<br>agacacttgttctcttggggtttgatgtggaaagcttttcttcgcttggtcccaattttgtctttcaatttcttcgccgc<br>catcatgaaccaaatctacgatgttgatatcgaccgtatcaacaagccagacttaccttagtttccggtgaaatgtcca<br>ttgaaactgcttggatcttgtctatcattgttgccttgactggtttaattgttactattaagttgaagtccgctccattgt<br>ttgtcttcatctacatcttcggtatcttcgctgtttcgcttactccgtcccacctattagatggaaacaatatcctttta<br>ccaaatttcttgatcactatttcctctcatgttggtttggctttcacttcttactctgccaccacttctgctttaggttt |

TABLE 1-continued

Amino acid and nucleotide sequences of the disclosure

| SEQ ID | SEQUENCE |
|---|---|
| | gcctttcgtttggcgtcctgccttctctttcattattgctttcatgactgtcatgggtatgactattgcctttgctaaag<br>acatttctgatatcgaaggtgatgctaagtacggtgtctctaccgttgctaccaagttaggtgctagaaatatgactttg<br>ttgtttctggtgtcttattgttgaactacttggtttctatctctattggtatcatttggccacaagttttcaagtctaaca<br>ttatgatcttgtctcatgctattttggctttctgtttgatctttcaaactcgtgaattagccttagccaattatgcctctg<br>ccccatcccgtcaattttcgaattcatctggttgttatactatgccgaatacttcgttacgtcttcatttaa |
| SEQ ID NO: 112<br>Truncated acyl<br>activating enzyme<br>AAE (CsAAE3<br>truncation) | MEKSGYGRDGIYRSLRPPLHLPNNNNLSMVSFLFRNSSSYPQKPALIDS<br>ETNQILSFSHFKSTVIKVSHGFLNLGIKKNDWLIYAPNSIHFPVCFLGIIA<br>SGAIATTSNPLYTVSELSKQVKDSNPKLIITVPQLLEKVKGFNLPTILIGP<br>DSEQESSSDKVMTFNDLVNLGGSSGSEFPIVDDFKQSDTAALLYSSGTT<br>GMSKGWLTHKNFIASSLMVTMEQDLVGEMDNVFLCFLPMFHVFGLAI<br>ITYAQLQRGNTVISARFDLEKMLKDVEKYVTHLWWPPVILALSKNSM<br>VKFNLSSIKYIGSGAAPLGKDLMEECSKWPYGIVAQGYGMTETCGIVS<br>MEDIRGGKRNSGSAGMLASGVEAQIVSVDTLKPLPPNQLGEIWVKGPN<br>MMQGYFNNPQATKLTIDKKGWVHTGDLGYFDEDGHLYWDRIKELIK<br>YKGFQVAPAELEGLLVSHPEILDAWIPFPDAEAGEVPVAYWRSPNSSL<br>TENDVKKFIAGQVASFKRLRKVTFINSVPKSASGKILR |
| SEQ ID NO: 113<br>Truncated 3-hydroxy-<br>3-methyl-glutaryl-<br>CoA reductase<br>(tHMG1) | MSDQLVKTEVTKKSFTAPVQKASTPVLTNKTVISGSKVKSLSSAQSSSS<br>GPSSSSEEDDSRDIESLDKKIRPLEELEALLSSGNTKQLKNKEVAALVIH<br>GKLPLYALEKKLGDTTRAVAVRRKALSILAEAPVLASDRLPYKNYDY<br>DRVFGACCENVIGYMPLPVGVIGPLVIDGTSYHIPMATTEGCLVASAM<br>RGCKAINAGGGATTVLTKDGMTRGPVVRFPTLKRSGACKIWLDSEEG<br>QNAIKKAFNSTSRFARLQHIQTCLAGDLLFMRFRTTTGDAMGMNMISK<br>GVEYSLKQMVEEYGWEDMEVVSVSGNYCTDKKPAAINWIEGRGKSV<br>VAEATIPGDVVRKVLKSDVSALVELNIAKNLVGSAMAGSVGGFNAHA<br>ANLVTAVFLALGQDPAQNVESSNCITLMKEVDGDLRISVSMPSIEVGTI<br>GGGTVLEPQGAMLDLLGVRGPHATAPGTNARQLARIVACAVLAGELS<br>LCAALAAGHLVQSHMTHNRKPAEPTKPNNLDATDINRLKDGSVTCIKS* |
| SEQ ID NO: 114<br>Truncated 3-hydroxy-<br>3-methyl-glutaryl-<br>CoA reductase<br>(tHMG1) | atgtccgatcaattagtcaagaccgaagtcaccaagaagtccttcaccgccccagttcaaaaagcctccactcca<br>gtcttaactaacaagaccgttatttctggttccaaggttaagtctttatcctccgctcaatcctcctcttccggtccatc<br>ttcttcttctgaagaagatgattcccgtgacattgagtcctggataagaaaatcagacctttggaagaattagaag<br>ctttgttatcctctgtgaataatactaagcaattgaaaaacaaggaagttgctgctttagctttattcacggtaaattacctttg<br>tacgctttagaagaagaagttaggtgacactacccgtgctgtcgccgttagaagaaaagctttgtctatttagctga<br>ggccctgttttggctctgacagattaccataccaagaattacgattacgatagagttttcggtgcctgttgtgagaa<br>cgttatcggttatatgccattaccagtcggtgttatcggtccattggttattgacggtacctcttaccacatcccaatg<br>gctactactgaaggttgtttagtcgcctccgccatggaggttgtaaggctatcaatgctggtggtggtgctactac<br>cgtcttgactaaggatggtatgactagaggtccagttgtccgttttccaactttgaaaagatctggtgcttgtaagatt<br>tggttggattctgaagaaggtcaaaatgccattaagaaggctttcaattccacctctagatttgccagattacaacat<br>attcaaacctgtttagccggtgatttgttgttcatgagattcagaactactactggtgatgctatgggtatgaacatga<br>tctctaagggtgtcgaatattcttttaaaacaaatggttgaaagatatggttgggaagacatggaggtcgtctctgtct<br>ctggtaactactgtactgataagaaaccagctgctatcaactggatcgaaggtcgtggtaagtctgttgttgccga<br>agctactattccaggtgatgttgttagaaaggttttaaaatccgatgtctctgccttggttgagttgaacattgctaaa<br>aacttggttggttctgctatggctggttctgtcggtggttttaatgcccatgccgccaacttagtcaccgccgttttctt<br>agctttgggtcaagatccagctcaaaatgtcgaatcctccaactgtatcactttgatgaaagaggtcgacggtgac<br>ttgcgtatctctgtttccatgccatctatcgaagttggtactatcggtggtggtactgttttggagccacaaggtgcta<br>tgttggacttattgggtgttagaggtccacacgccactgctcctggtaccaacgccagacaattagctagaatcgt<br>tgcctgtgccgtcttagctggtgagttgtctttatgtgctgccttagctgctggtcacttggtccaatcccacatgact<br>cataacagaaagccagctgaacctaccaagcctaacaacttggatgccaccgatattaatcgtttaaaagatggtt<br>ctgtcacttgcattaagtcctaa |
| SEQ ID NO: 115<br>HMG-CoA synthase<br>(Sc_ERG13)<br>Saccharomyces sp. | MTELKKQKTAEQKTRPQNVGIKGIQIYIPTQCVNQSELEKFDGVSQGK<br>YTIGLGQTNMSFVNDREDIYSMSLTVLSKLIKSYNIDTNKIGRLEVGTE<br>TLIDKSKSVKSVLMQLFGENTDVEGIDTLNACYGGTNALFNSLNWIES<br>NAWDGRDAIVVCGDIAIYDKGAARPTGGAGTVAMWIGPDAPIVFDSV<br>RASYMEHAYDFYKPDFTSEYPYVDGHFSLTCYVKALDQVYKSYSKKA<br>ISKGLVSDPAGSDALNVLKYFDYNVFHVPTCKLVTKSYGRLLYNDFRA<br>NPQLFPEVDAELATRDYDESLTDKNIEKTFVNVAKPFHKERVAQSLIVP<br>TNTGNMYTASVYAAFASLLNYVGSDDLQGKRVGLFSYGSGLAASLYS<br>CKIVGDVQHIIKELDITNKLAKRITETPKDYEAAIELRENAHLKKNFKP<br>QGSIEHLQSGVYYLTNIDDKFRRSYDVKK* |
| SEQ ID NO: 116<br>Artificial HMG-CoA<br>synthase<br>(Sc_ERG13)<br>nucleotide sequence | atgaccgaattgaagaagcaaaagactgctgaacaaaaaacccgtccacaaaatgttggtatcaagggtattca<br>aatctacattccaactcaatgcgtcaaccaatctgaattggaaaaatttgatggtgtttctcaaggtaaatacactat<br>tggtttgggtcaaactaatatgtccttcgttaacgacagagaagatatttactccatgtccttgaccgtcttgtccaaat<br>tgattaagtcttataatattgacaccaacaagatcggtagattggaggttggtactgaaactctttgattgataagtctaa<br>gtctgttaagtctgtttaatgcaattgttcggtgaaaatactgacgttgaaggtattgacactttgaacgcttgttacg<br>gtggtactaatgctttatttaactctttgaactggattgaatccaacgcttgggacggtagagatgccattgtcgtttg<br>tggtgacattgctatctatgacaagggtgccgctcgtccaactggtggtgctggtaccgttgctatgtggatcggt<br>cctgacgccccaatcgttttcgactctgttcgtgcttcttacatggaacatgcttacgactttacaagctccacagtctacaagtcttact<br>ccaagaaggccatttccaaggggtttagtctccgatccagctggttccgatgcttaaacgttttaaagtacttcgatt<br>acaacgttttccatgtccctacttgtaaattggttaccaaatcttacggtagattattgtacaacgatttcagagctaat<br>ccacaattatttccagaagtcgatgctgagttggctactagagattacgacgaatccttgaccgacaaaaatattga<br>aaagacttttgttaacgttgctaagccatttcacaaagagagagttgcccaatctttgattgtcccaactaatactggt |

TABLE 1-continued

Amino acid and nucleotide sequences of the disclosure

| SEQ ID | SEQUENCE |
|---|---|
| | aatatgtatactgcttctgtttacgctgcctttgcttctttgttgaactatgtcggttctgacgacttacaaggtaagcgt<br>gtcggtttgttctcctacggttccggtttggctgcctcttgtattcttgtaagattgtcggtgatgttcaacacatcatc<br>aaggaattggatatcaccaataaattggccaagagaatcactgaaactcctaaagactatgaagctgctatcgaat<br>tgagagaaaatgctcatttaaagaaaaactttaaaccacaaggttctattgaacacttgcaatccggtgtttactact<br>taactaacatcgatgacaagttccgtagatcctacgacgtcaagaagtaa |
| SEQ ID NO: 117<br>Pyruvate<br>decarboxylase<br>complex (Zm_PDC)<br>Zymomonas mobilis | MSYTVGTYLAERLVQIGLKHHFAVAGDYNLVLLDNLLLNKNMEQVY<br>CCNELNCGFSAEGYARAKGAAAAVVTYSVGALSAFDAIGGAYAENLP<br>VILISGAPNNNDHAAGHVLHHALGKTDYHYQLEMAKNITAAAEAIYT<br>PEEAPAKIDHVIKTALREKKPVYLEIACNIASMPCAAPGPASALFNDEA<br>SDEASLNAAVEETLKFIANRDKVAVLVGSKLRAAGAEEAAVKFADAL<br>GGAVATMAAAKSFFPEENPHYIGTSWGEVSYPGVEKTMKEADAVIAL<br>APVFNDYSTTGWTDIPDPKKLVLAEPRSVVVNGIRFPSVHLKDYLTRL<br>AQKVSKKTGALDFFKSLNAGELKKAAPADPSAPLVNAEIARQVEALLT<br>PNTTVIAETGDSWFNAQRMKLPNGARVEYEMQWGHIGWSVPAAFGY<br>AVGAPERRNILMVGDGSFQLTAQEVAQMVRLKLPVIIFLINNYGYTIEV<br>MIHDGPYNNIKNWDYAGLMEVFNGNGGYDSGAGKGLKAKTGGELAE<br>AIKVALANTDGPTLIECFIGREDCTEELVKWGKRVAAANSRKPVNKLL* |
| SEQ ID NO: 118<br>Artificial pyruvate<br>decarboxylase<br>(Zm_PDC)<br>nucleotide sequence | atgtcctacaccgttggtacctacttagctgagcgtttggtccaaatcggtttgaagcaccatttcgccgttgctggt<br>gattacaacttggtcttgttagataatttattattgaacaagaacatggaacaagtctactgctgtaatgaattgaact<br>gtggtttctctgctgaaggttatgctagagctaaaggtgccgctgccgctgttgtcacttactctgttggtgctttgtc<br>tgccttcgacgctattggtggtgcttacgccgagaatttacctgttattttaatttctggtgcccctaacaataacgat<br>catgctgctggtcatgttttacaccacgctttgggtaaaactgactaccattatcaattagagatggccaaaaacat<br>caccgccgctgccgaggccattcaactccagaagaagcccagccaaaattgatcacgtcatcaaaaccgcc<br>ttgagagagaaaaaacctgtttacttggaaatcgcctgtaatatcgcctctatgccttgcgccgctcctggtcctgc<br>ttccgccttattcaacgatgaggcttctgatgaagcttccttaaacgctgctgttgaggagacttaaagttcatcgct<br>aatagagataaggtcgctgttttagtcggttctaagttgcgtgctgccggtgccgaggaagctgctgttaaattcgc<br>cgatgctttaggtggtgctgtcgccaccatggccgccgcaaatccttttcctgaagaaaaccccacactacatc<br>ggtacttcttgggtgaagtctcttacccaggtgtcgaaaagactatgaaggaagccgatgccgtcatcgccttg<br>gccccagttttaatgattattccaccactggttggactgatatccagatcctaaaaagtagttttagccgagccta<br>gatccgttgttgttaacggtattagattcccttccgttcacttgaaggattacttaactagattggctcaaaaggtttcc<br>aagaagaccggtgcttggacttttcaaatctttgaacgccggtgagttaaagaaggccgcccctgctgacccat<br>ctgctccattgtaacgctgagattgctagacaagtcgaagctttattgacccaaacactaccgtttatcgccgaa<br>actggtgactcttggtttaatgctcaaagaatgaagttaccaaatggtgccagagttgagtacgaaatgcaatggg<br>gtcatatcggttggtctgtcccagctgcttttggttatgctgttggtgccctgagagaagaaacatcttgatggttg<br>gtgacggttccttccaattgactgctcaagaagtcgctcaaatggttagattaaaattaccagtcatcatcttcttgat<br>caataactacggttacactatcgaagtcatgattcacgatggtccttacaataattattaagaactgggactatgctg<br>gtttgatggaagtctttaatggtaacggtggttacgattccggtgctggtaagggtttaaaggctaagactggtggt<br>gaattagctgaagccattaaggttgccttggctaacaccgacggtcctactttaatcgaatgtttcattggtagaga<br>ggattgtaccgaagagttagttaagtggggtaagagagttgccgctgctaattcccgtaagcctgtcaataaattg<br>ttataa |
| SEQ ID NO: 119<br>Truncated 3-hydroxy-<br>3-methyl-glutaryl-<br>CoA reductase<br>(tHMG1) | atgcaattggtgaagactgaagtcaccaagaagtctttactgctcctgtacaaaaggcttctacaccagttttaac<br>caataaaacagtcatttctggatcgaaagtcaaaagtttatcatctgcgcaatcgagctcatcaggaccttcatcat<br>ctagtgaggaagatgattcccgcgatattgaaagcttgataagaaaatacgtccttagaagaattagaagcatt<br>attaagtagtggaaatacaaaacaattgaagaacaaagaggtcgctgccttggtttattcacggtaagttaccttgt<br>acgctttggagaaaaaattaggtgatactacgagagcggttgcggtacgtaggaaggctcttcaattttggcaga<br>agctcctgtattagcatctgatcgttaccatataaaaaattatgactacgaccgcgtatttggcgcttgttgtgaaaat<br>gttataggttacatgcctttgcccgttggtgttataggcccttggttatcgatggtacatcttatcatataccaatggc<br>aactacagagggttgtttggtagcttctgccatgcgtggcgtgtaaggcaatcaatgctggcggtggtgcaacaac<br>tgttttaactaaggatggtatgacaagagggccccagtagtccgtttcccaactttgaaaagatcggtgcctgtaaga<br>tatggttagactcagaagagggacaaaacgcaattaaaaaagctttaactctacatcaagatttgcacgtctgca<br>acatattcaaacttgtctagcaggagatttactcttcatgagatttagaacaactactggtgacgcaatgggtatgaa<br>tatgatttctcaaggtgtcgaatactcattaaagcaaatggtagaagatgatggagcctggagctgctggtgtct<br>ccgtttctggtaactactgtaccgacaaaaaccagctgccatcaactggatcgaaggtcgtggtaagagtgtcg<br>tcgcagaagctactattcctggtgatgttgtcagaaaagtgttaaaaagtgatgtttccgcattggttgagttgaaca<br>ttgctaagaatttggttggatctgcaatggctgggtctgttggtggattaacgcacatgcagctaatttagtgacag<br>ctgtttttcttggcattaggacaagatcctgcacaaaatgtcgaaagttccaactgtataacattgatgaaagaagtg<br>gacggtgatttgagaatttccgtatccatgccatccatcgaagtaggtaccatcggtggtggtactgttctagaacc<br>acaaggtgccatgttggacttattaggtgtaagaggcccacatgctaccgctcctggtaccaacgcacgtcaatt<br>agcaagaatagttgcctgtgccgtcttgcaggtgaattatccttatgtgctgcctagcagccggccatttggttc<br>aaagtcatatgacccacaacaggaaaacctgctgaaccaacaaaacctaacaatttggacgccactgatataaatc<br>gtttgaaagatgggtccgtcacctgcattaaatcctaa |
| SEQ ID NO: 120<br>HMG-CoA synthase<br>(Sc_ERG13)<br>Saccharomyces sp. | atgactgaactaaaaaacaaagaccgctgaacaaaaaaccagacctcaaaatgtcggtattaaaggtatcca<br>aatttacatcccaactcaatgtgtcaaccaatctgagctagagaaatttgatggcgtttctcaaggtaaatacacaat<br>tggtctgggccaaaccaacatgtcttttgtcaatgacagagaagatatctactcgatgtcccctaactgttttgtctaa<br>gttgatcaagagttacaacatcgacaccaacaaaattggtagattagaagtcggtactgaaactctgattgacaag<br>tccaagtctgtcaagtctgtcttgatgcaattgtttggtgaaaacactgacgtcgaaggtattgacacgcttaatgcc<br>tgttcggtggtaccaacgcgttgttcaactcttgaactggattgaatctaacgcatgggatggtagagacgccat<br>tgtagtttgcggtgatattgccatctacgataagggtgccgcaagaccaaccggtggtgccggtactgttgctatg<br>tggatcggtcctgatgctccaattgtatttgactctgtaagagctcttacatggaacacgcctacgattttacaagc<br>cagatttcaccagcgaatatccttacgtcgatggtcatttttcattaacttgttacgtcaaggctcttgatcaagtttac<br>aagagttattccaagaaggctatttctaaagggttggttagcgatcccgctggttcggatgctttgaacgttttgaaa<br>tatttcgactacaacgttttccatgttccaacctgtaaattggtcacaaaatcatacggtagattactatataacgattt |

TABLE 1-continued

Amino acid and nucleotide sequences of the disclosure

| SEQ ID | SEQUENCE |
|---|---|
| | cagagccaatcctcaattgttcccagaagttgacgccgaattagctactcgcgattatgacgaatctttaaccgata<br>agaacattgaaaaaacttttgttaatgttgctaagccattccacaaagagagagttgcccaatctttgattgttccaa<br>caaacacaggtaacatgtacaccgcatctgtttatgccgcctttgcatctctattaaactatgttggatctgacgactt<br>acaaggcaagcgtgttggttttattttcttacggttccggtttagctgcatctctatattcttgcaaaattgttggtgacgt<br>ccaacatattatcaaggaattagatattactaacaaattagccaagagaatcaccgaaactccaaaggattacgaa<br>gctgccatcgaattgagagaaaatgcccatttgaagaagaacttcaaacctcaaggttccattgagcatttgcaaa<br>gtggtgtttactacttgaccaacatcgatgacaaatttagaagatcttacgatgttaaaaaataat |
| SEQ ID NO: 121<br>Geranylgeranyl<br>pyrophosphate<br>synthase (Cr_GPPS)<br>Catharanthus sp. | MLFSRGLYRIARTSLNRSRLLYPLQSQSPELLQSFQFRSPIGSSQKVSGF<br>RVIYSCVSSALANVGQQVQRQSNSVAEEPLDPFSLVADELSILANRLRS<br>MVVAEVPKLASAAEYFFKLGVEGKRFRPTVLLLMATAIDAPISRTPPD<br>TSLDTLSTELRLRQQSIAEITEMIHVASLLHDDVLDDAETRRGIGSLNFV<br>MGNKLAVLAGDFLLSRACVALASLKNTEVVSLLATVVEHLVTGETMQ<br>MTTTSDQRCSMEYYMQKTYYKTASLISNSCKAIALLAGQTSEVAMLA<br>YEYGKNLGLAFQLIDDVLDFTGTSASLGKGSLSDIRHGIVTAPILFAIEE<br>FPELRAVVDEGFENPYNVDLALHYLGKSRGIQRTRELAIKHANLASDA<br>IDSLPVTDDEHVLRSRRALVELTQRVITRRK* |
| SEQ ID NO: 122<br>Artificial<br>geranylgeranyl<br>pyrophosphate<br>synthase (Cr_GPPS)<br>nucleotide sequence | atgttattctctcgtggtttatacagaatcgccagaacttctttgaacagatcccgtttgttgtaccctttacaatctcaa<br>tctcctgaattgttacaatccttccaattcagatctccaatcggttcctctcaaaaggtttccggtttcagagttatcta<br>ctcctgcgtttcctctgcttttagctaacgttggtcaacaagtccaaagacaatctaattccgttgctgaagaaccttg<br>gacccattctccttggttgccgatgaattatccatttagctaacagattgcgttctatgctcgctgaagttccaa<br>agttagcctccgccgccgaatatttcttcaagttgggtgtcgagggtaaaagattcagaccaactgttttgttgttaa<br>tggccaccgccattgatgcccaatctctagaaccccacctgacacctccttagatactttatccaccgaattgcgt<br>ttgagacaacaatctatcgccgaaattactgaaatgattcatgtcgcttccttgttgcacgatgatgttttggatgatg<br>ctgaaactagaagaggtattggttcttttaaattttgtcatgggtaacaaattggctgtttttggccggtgacttcttattat<br>ctagagcttgtgttgccttagcttctttgaaaaaacactgaagtcgtctccttgttagcactgtcgttgaacacttagtt<br>actggtgagactatgcaaatgactaccacctccgatcaaagatgttctatggaatactacatgcaaagaccattt<br>acaagactgcctctttgattctaactcctgtaaagccattgccttgttagctggtcaaacttctgaagttgccatgttg<br>gcttacgaatacgtaaaaacttgggtttggctttccaattgattgatgatgttttggatttcactggtacttctgcttcc<br>ttaggtaaaggttcttgtctgatattcgtcacggtatcgttaccgccccaatcttgttcgctattgaagaattcccag<br>agttaagagctgttgttgacgaaggtttcgaaaacccttacaatgttgacttagccttgcactacttgggtaaatcta<br>gaggtattcaacgtaccagagaattagccattaaacatgctaacttagcctctgacgccattgactctttaccagtc<br>actgatgatgagcacgtcttacgttccagacgtgccttagttgaattgactcaaagagttattactagaagaaagtaa |
| SEQ ID NO: 123<br>Geranylgeranyl<br>pyrophosphate<br>synthase (Mi_GPPS1)<br>Mangifera indica | MLFSYGLSRISINPRASLLTCRWLLSHLTGSLSPSTSSHTISDSVHKVWG<br>CREAYTWSVPALHGFRHQIHHQSSSLIEDQLDPFSLVADELSLVANRLR<br>SMVVTEVPKLASAAEYFFKMGVEGKRFRPAVLLLMATALNVHVLEPL<br>PEGAGDALMTELRTRQQCIAEITEMIHVASLLHDDVLDDADTRRGIGS<br>LNLVMGNKLAVLAGDFLLSRACVALASLKNTEVVSLLATVVEHLVTG<br>ETMQMTTSSDQRCSMEYYMQKTYYKTASLISNSCKAIALLAGQSAEV<br>AMLAPEFGKNLGLAYQLIDDVLDFTGTSASLGKGSLSDIRHGIVTAPIL<br>FAMEEFPQLRAVIDQGFENPSNVDVALEYLGKSRGIQRTRELATNHAN<br>LAAAAIDALPKTDNEEVRKSRRALLDLTQRVITRNK* |
| SEQ ID NO: 124<br>Artificial<br>geranylgeranyl<br>pyrophosphate<br>synthase (Mi_GPPS1)<br>nucleotide sequence | atgttattctcttatggtttatctcgtatttctattaaccctcgtgccctcttattgacttgtagatggttattatcccat<br>ttgactggttctttatctccttccacttcttcccatactatttctgactccgtccataaagtctggggttgcagagaagcc<br>tatacttggtctgtcccagctttacatggttttagacataaatccaccatcaatcctcttccttgattgaagatcaatta<br>gacccattctccttggtcgccgatgagttgtccttggttgctaaccgtttaagatctatggttgtcactgaagtccctaaa<br>ttagcctctgcgccgaatactttttcaagatgggtgtcgaaggtaagcgtttcagaccagctgtcttgttgttaatg<br>gccactgccttaaacgttcatgttttgcctgaaggtgctggtgacgctttaatgaccgagttgagaac<br>cgtcaacaatgcattgctgaaattcactgagatgatccacgtcgcctcttcattgcatgacgatgttttagacgacg<br>ctgatactagaagaggtattggttctttgaacttggttatgggtaacaaattggccgttttggccggtgatttcttgtta<br>tcccgtgcttgcgttgctttagcttctttgaagaacactgaagttgtttcttgttggccaccgtcgttgaacacttagtt<br>actggtgagactatgcaaatgaccacctcttctgaccaaagatgttccatggaattatcatgcaaaaacttatta<br>caaaaccgcctccttgatttctaactcctgtaaagccatcgccttattagctggtcaatctgctgaagttgccatgtta<br>gccttcgagtttggtaagaacttgggtttagcttaccaattgatcgatgatgtcttggattttaccggtacctctgcttc<br>tttgggtaagggttccttgtccgacattagacacggtattgttaccgccccaatcttattcgctatggaagagtttcc<br>acaattggacgctgttatcgaccaagttttcgagaacccatctaacgttgacgtcgccttagagtatttaggtaaat<br>ctagaggtatccaacgtacccgtgaattagctactaaccatgctaacttagccgccgccgccatcgatgccttgc<br>ctaaaaccgataatgaagaagtccgtaagtccagacgtgcttattagatttgactcaaagagtcatcaccagaaa<br>caaatag |
| SEQ ID NO: 125<br>Geranylgeranyl<br>pyrophosphate<br>synthase (Mi_GPPS2)<br>Mangifera indica | MPFVVPRRNRSLSVSAVLTKEETLREEEEDPKPVFDFKSYMLQKGNSV<br>NQALDAVVSIREPKKIHEAMRYSLLAGGKRVRPVLCIAACELVGGNES<br>MAMPAACAVEMIHTMSLIHDDLPCMDNDDLRRGKPTNHKVFGEDVA<br>VLAGDALLAFSFENMAVSTVGVLPSRVVKAVGELAKSIGIEGLVAGQV<br>VDINSEGLKEVGLDHLEFIHQHKTAALLEGSVVLGAILGGGSDDEVEK<br>LRTFARCIGLLFQVVDDILDVTKSSRELGKTAGKDLVADKVTYPKLLGI<br>EKSRELADKLNKDAQQQLSGFDQEKAAPLIALSNYIAYRQN* |
| SEQ ID NO: 126<br>Artificial<br>geranylgeranyl<br>pyrophosphate<br>synthase (Mi_GPPS2) | atgccattcgttgttcctagaagaaaccgttctttgtccgtttccgccgttttgaccaaggaagaaactttaagagag<br>gaagaagaagatccaaagccagtttttcgacttcaaatcttacatgttacaaaagggtaattctgttaatcaagctttg<br>gatgctgtcgttttccattagagaacctaagaaaatccatgaggctatgcgttactcttttgttggctggtggtaagag<br>agttcgtcctgttttgtgtattgccgcctgtgaattggtcggtggtaacgaatctatggctatgccagccgcctgtgc<br>tgtcgaaattgatccacactatgtccttgattcacgatgatttgccatgtatggataatgacgatttgcgtcgtggtaa |

TABLE 1-continued

Amino acid and nucleotide sequences of the disclosure

| SEQ ID | SEQUENCE |
|---|---|
| nucleotide sequence | acctaccaaccatcaaagttttcggtgaagacgtcgccgttttggctggtgacgctttattagcttttccttcgagaac<br>atggccgtttccactgttggtgtcttaccatccagagttgtcaaggctgttggtgaattggccaagtctatcggtatt<br>gaaggtttggttgccggtcaagtcgtcgatattaattctgagggtttaaaagaggtcggtttagatcacttagaattt<br>atccatcaacacaaaaccgctgctttgttggagggttctgttgtttgggtgctattttaggtggtggttctgatgatg<br>aagtcgaaaagttgcgtacctttgctagatgtatcggtttgtgttttcaagttgttgacgatattttggatgtcactaag<br>tcttccagagaattgggtaagactgccggtaaagatttggttgctgataaagttacttatccaaagttgttaggtattg<br>aaaagtctcgtgaattggccgataagttaaacaaggatgctcaacaacaattatccggttttgatcaagagaaggc<br>tgccccttaatcgctttgtccaattacatcgcctacagacaaaactag |
| SEQ ID NO: 127<br>Truncated<br>geranylgeranyl<br>pyrophosphate<br>synthase<br>Cs2_GPPS_NTrunc | MVIAEVPKLASAAEYFFKMGVEGKRFRPTVLLLMATALNVRVPEPLH<br>DGVEDASATELRTRQQCIAEITEMIHVASLLHDDVLDDADTRRGIGSL<br>NFVMGNKLAVLAGDFLLSRACVALASLKNTEVVTLLATVVEHLVTGE<br>TMQMTTSSDQRCSMDYYMQKTYYKTASLISNSCKAIALLAGQTAEVA<br>ILAFDYGKNLGLAYQLIDDVLDFTGTSASLGKGSLSDIRHGIITAPILFA<br>MEEFPQLRTVVEQGFEDSSNVDIALEYLGKSRGIQKTRELAVKHANLA<br>AAAIDSLPENNDEDVTKSRRALLDLTHRVITRNK* |
| SEQ ID NO: 128<br>Truncated<br>geranylgeranyl<br>pyrophosphate<br>synthase<br>Cs2_GPPS_NTrunc | atggtcattgctgaagttcctaaattagcctctgccgccgaatacttcttcaagatgggtgtcgagggtaagagatt<br>tcgtcctaccgttttgttgttaatggccaccgccttaaacgtcagagtccctgaaccattacatgatggtgttgaaga<br>tgcctctgccaccgagttgagaactagacaacaatgtattgctgaaatcaccgagatgattcacgttgcctcttgtt<br>gcacgatgatgttttggatgctgatacccgtcggtatcggttctttgaactttgtcatgggtaacaagttggct<br>gtcttggctggtgatttcttattgtctcgtgcctgcgttgccttagcctctttaaaaaataccgaagttgttacttattg<br>gccactgttgttgagcacttggttactggtgaaactatgcaaatgaccacctcttccgaccaacgttgttccatgga<br>ctattacatgcaaaagacctactacaagaccgcttcttttgatttccaattcttgtaaagccattgccttattagctggtc<br>aaactgctgaagttgccatcttggccttcgactacggtaaaaacttgggttttagcttaccaattgattgatgacgttttag<br>atttactggtacttctgcttctttgggtaaaggttcttttatccgatattcgtcatggtatcattaccgctccaatctta<br>ttcgctatgaagaatttccctcaattgcgtactgtcgttgaacaaggtttcgaagactcctccaacgttgacattgcc<br>ttagaatacttgggtaagtctcgtggtattcaaaagacccgtgaattagccgttaaacatgccaacttagccgccg<br>ccgccatcgattccttgcctgaaaacaacgatgaggatgtcaccaagtcccgtcgtgctttgttagatttaactcac<br>agagttattacccgtaacaagtaa |
| SEQ ID NO: 129<br>Geranylgeranyl<br>pyrophosphate<br>synthase (Qr_GPPS)<br>*Quercus* sp. | MLFSRISRIRRPGSNGFRWFLSHKTHLQFLNPPAYSYSSTHKVLGCREIF<br>SWGLPALHGFRHNIHHQSSSIVEEQNDPFSLVADELSMVANRLRSMVV<br>TEVPKLASAAEYFFKMGVEGKRFRPTVLLLMATAMNISILEPSLRGPG<br>DALTTELRARQQRIAEITEMIHVASLLHDDVLDDADTRRGIGSLNFVM<br>GNKLAVLAGDFLLSRACVALASLKNTEVVSLLAKVVEHLVTGETMQ<br>MTTTCEQRCSMEYYMQKTYYKTASLISNSCKAIALLGGQTSEVAMLA<br>YEYGKNLGLAYQLIDDVLDFTGTSASLGKGSLSDIRHGIITAPILFAMEE<br>FPQLREVVDRGFDDPANVDVALDYLGKSRGIQRARELAKKHANIAAE<br>AIDSLPESNDEDVRKSRRALLDLTERVITRTK* |
| SEQ ID NO: 130<br>Artificial<br>geranylgeranyl<br>pyrophosphate<br>synthase (Qr_GPPS)<br>nucleotide sequence | atgttgttctctcgtatttctcgtatccgtagaccaggttctaatggtttcagatggttcttgtcccataagactcattta<br>caattcttgaaccctccagcttattcctactcttccactcataaggtcttgggttgtagagaaatttttcctgggtttta<br>cctgccttacatggtttcagacacaacattcaccaccaatcttcctctattgttgaagaacaaaatgaccctttctcttt<br>ggtcgctgatgagttgtccatggttgctaacagattgcgttctatggttgttactgaagttcctaaattagcctccgcc<br>gctgaaactttttaaaatgggtgttgaaggtaagagattcagaccaactgttttattgttgatggtaccgccatga<br>acatttccatcttagaaccatcttttgagaggtccaggtgacgctttgaccactgaattgagacgacagacaacaaag<br>aattgctgaaattaccgagatgatccacgttgcttccttgttgcacgatgacgtttggatgacgctgatactagaag<br>aggtattggttcctttaaactttgtcatgggtaataaattagctgtttggctggtgattttttgtatctcgtgcctgtgt<br>tgctttagcttctttgaagaacaccgaagttgtctccttgttagccaaggtcgtcgaacacttggttactggtgaaactat<br>gcaaatgaccactacttgtgaacaaagatgttccatggaatactacatgcaaaagacttactataagaccgcttctt<br>taatttccaactcctgtaaagccattgctttattaggtggtcaaacttctgaggtcgctatgttagcctacgaatatgg<br>taaaaacttgggtttagcttaccaattgattgatgatgtcttggatttcactggtacttctgcttccttgggtaagggttc<br>cttgtctgatattagacatggtatcattactgctccaattttgtttgctatggaagaatttcccacaattacgtgaagttgt<br>cgatagaggtttcgacgatcctgccaacgtcgatgttgccttggactacttgggtaagtctagaggtatccaaaga<br>gccagagagttagctaaaaaacacgctaacattgctgccgaagccatcgactctttgccagaatccaacgacga<br>ggacgtcagaaagtcccgtcgtgcttgttggacttgaccgaaagagtcattactcgtactaagtaa |
| SEQ ID NO: 131<br>Truncated<br>geranylgeranyl<br>pyrophosphate<br>synthase<br>Pa_GPPS_Ntrunc | MYTRCILRDKYSRFNLRRKFFTSAKSINALNGLPDSGNPRGESNGISQF<br>EIQQVFRCKEYIWIDRHKFHDVGFQAHHKGSITDEEQVDPFSLVADELS<br>ILANRLRSMILTEIPKLGTAAEYFFKLGVEGKRFRPMVLLLMASSLTIGI<br>PEVAADCLRKGLDEEQRLRQQRIAEITEMIHVASLLHDDVLDDADTRR<br>GVGSLNFVMGNKLAVLAGDFLLSRASVALASLKNTEVVELLSKVLEH<br>LVTGEIMQMTNTNEQRCSMEYYMQKTFYKTASLMANSCKAIALIAGQ<br>PAEVCMLAYDYGRNLGLAYQLLDDVLDFTGTTASLGKGSLSDIRQGIV<br>TAPILFALEEFPQLHDVINRKFKKPGDIDLALEFLGKSDGIRKAKQLAA<br>QHAGLAAFSVESFPPSESEYVKLCRKALIDLSEKVITRTR* |
| SEQ ID NO: 132<br>Truncated<br>geranylgeranyl<br>pyrophosphate<br>synthase<br>Pa_GPPS_N_trunc | atgtataccgttgcattttaagagacaagtattctcgtttcaacttgagacgtaaattcttcacttccgctaaatccat<br>caatgccttgaatggtttacctgactctggtaacccagaggtgaatctaacggtatctcccaattcgaaattcaac<br>aagttttccgtctgtaaagaatacatttggatcgatcgtcacaagttccacgatgttggttttcaagctcatcacaagg<br>gttccatcactgacgaggaacaagtcgaccctttctcttagtcgctgatgaattgtccatctagctaatcgtttaaga<br>tccatgatcttaaccgagattccaaagttaggtaccgctgccgaatacttttcaagttgggtgtcgaaggtaagag<br>atttagaccaatggttttgttgttgatggcctcctcttaactattggtatccctgaagttgccgctgattgttgcgtaa<br>gggtttggacgaagaacaaagattacgtcaacaacgtatcgctgaaattactgaaatgattcatgtcgcctcttgt<br>tgcacgatgatgtttttggatgacgccgatactagacgtggtgttggttccttgaactttgttatgggtaacaagttgg |

TABLE 1-continued

Amino acid and nucleotide sequences of the disclosure

| SEQ ID | SEQUENCE |
| --- | --- |
|  | ctgttttagccggtgattttcttgttatctagagcttctgttgccttagcttcttttaaagaacactgaggttgttgagtta<br>ttgtctaaggttttggagcacttagtcactggtgagatcatgcaaatgactaacactaatgaacaaagatgttctatgg<br>aatattacatgcaaaagactttctacaagaccgcctcttttgatggctaattcttgtaaagccattgccttgatcgctgg<br>tcaacctgccgaagtctgcatgttggcctacgactacggtagaaacttgggtttagcttatcaattattggatgacgt<br>tttggatttcactggtaccactgcttctttaggtaagggttccttatccgacatcagacaaggtattgttactgcccct<br>attttattcgctttggaagaattccctcaattacacgacgtcatcaaccgtaagttcaaaaaaccaggtgacatcgat<br>ttggccttggaattttgggtaagtctgatggtatccgtaaagccaaacaattggctgctcaacatgctggtttagct<br>gccttttctgtcgaatccttccaccatctgaatccgaatacgttaagttatgtagaaaggccttgatcgatttgtctga<br>aaaggtcattactcgtaccagataa |
| SEQ ID NO: 133<br>Geranylgeranyl<br>pyrophosphate<br>synthase Ag_GPPS<br>Abies grandis | MAYSAMATMGYNGMAASCHTLHPTSPLKPFHGASTSLEAFNGEHMG<br>LLRGYSKRKLSSYKNPASRSSNATVAQLLNPPQKGKKAVEFDFNKYM<br>DSKAMTVNEALNKAIPLRYPQKIYESMRYSLLAGGKRVRPVLCIAACE<br>LVGGTEELAIPTACAIEMIHTMSLMHDDLPCIDNDDLRRGKPTNHKIFG<br>EDTAVTAGNALHSYAFEHIAVSTSKTVGADRILRMVSELGRATGSEGV<br>MGGQMVDIASEGDPSIDLQTLEWIHIHKTAMLLECSVVCGAIIGGASEI<br>VIERARRYARCVGLLFQVVDDILDVTKSSDELGKTAGKDLISDKATYP<br>KLMGLEKAKEFSDELLNRAKGELSCFDPVKAAPLLGLADYVAFRQN* |
| SEQ ID NO: 134<br>Artificial<br>geranylgeranyl<br>pyrophosphate<br>synthase (Ag_GPPS)<br>nucleotide sequence | atggcttattctgctatggctactatgggttacaacggtatggctgcttcttgtcacactttacacccaacttctccatt<br>gaaacctttcacggtgctctacttccttggaagccttcaatggtgaacacatgggtttgttaagaggttattctaag<br>cgtaagttgtcctcttacaaaaatccagcttctcgttcctccaatgctaccgtcgctcaattattgaacccaccacaa<br>aagggtaagaaggctgttgaatttgacttcaataagtatatggattctaaggctatgaccgtcaacgaggctttgaa<br>taaagccatcccattgcgttacccacaaaagatctacgaatctatgagatattctttgttagctggtggtaagagagt<br>ccgtccagttttgtgtatcgccgcttgtgaattagtcggtggtactgaggagttagctattccaaccgcctgtgccat<br>cgaaatgatccacaccatgtcttgatgcacgatgatttgccatgtatcgacaacgatgacttgagacgtggtaaa<br>cctaccaatcataagattttcggtgaagatactgctgttactgccggtaacgctttacactcttacgccttcgaacat<br>attgctgtttctacttccaagactgttggtgctgatagaattttgagaatggtttctgaattaggtcgtgctactggttc<br>cgaaggtgtatgggtggtcaaatggtcgatattgcttctgaaggtgaccctccattgatttgcaaactttagaatg<br>gatccacatccacaagactgctatgttattagaatgtctgttgtctggtgccatcatcggtggtgcttctgaaatt<br>gttattgagagagccagacgttatgctcgttgtgtcggttttattgtttcaagttgttgacgacatttttagatgttaccaa<br>atcttctgacgaattgggtaaaactgctggtaaagatttaatctccgataaagccacctaccctaagttgatgggttt<br>ggagaaggccaaagagttttccgatgaattattaaacagagctaaaggtgaattgtcttgcttcgatccagttaag<br>gctgccccattgttaggtttggctgactacgttgccttcagacaaaactaa |
| SEQ ID NO: 135<br>Truncated<br>geranylgeranyl<br>pyrophosphate<br>synthase<br>Pb_GPPS_NTrunc | MAAIFPSIPSNFKPPQISQTLTRRRRPNRTLCTATSDQSYLSASSADIYSH<br>LLRSLPATIHPSVKAPIHSLLSSPIPPTIAPPLCLAATELVGGNPNSAINAA<br>CAIHLIHAVTHTRTAPPLAEFSPGVLLMTGDGLLVLAYEMLARSPAVD<br>ADTSVRVLKEVARTAAAVAAAYEGGREGELAAGAAACGVILGGGNE<br>EEVERGRRVGMFAGKMELVEAEVELRLGFEDAKAGAVRRLLEEMRF<br>TQSFVNVRNPFYGK* |
| SEQ ID NO: 136<br>Truncated<br>geranylgeranyl<br>pyrophosphate<br>synthase<br>Pb_GPPS_NTrunc | atggctgctatctttccatccattccatccaacttcaaaccacctcaaatctctcaaactttgaccagacgtagaaga<br>ccaaaccgtactttatgtactgccacctctgaccaatcttacttgtccgcttcttctgccgacatttattctcatttgtta<br>agatctttaccagctactattcatccatctgttaaagccccaatccattctttattgtcctctccaattcctccaaccatc<br>gctccaccttttgtgtttagctgctaccgaattggttggtggtaaccctaactctgccattaacgccgcctgtgccatt<br>catttgattcatgctgttactcatactagaaccgctccaccattagctgaatttttctcctggtgttttgttgatgactggt<br>gatggtttattagttttggcttacgagatgttggccagatcccagctgttgatgccgatacttctgtccgtgttttgaa<br>ggaagtcgctagaaccgccgccgcgtcgccgctgcttatgaaggtggtagagaaggtgaattagctgccggt<br>gccgctgcttgtggtgtcattttgggtggtggtaacgaagaagaggtcgaaagaggtcgtgagtcggtatgttc<br>gctggtaaaatggaattagttgaagctgaagtcgaattgagattgggttcgaagatgctaaagccggtgccgtta<br>gaagattgttggaagaaatgcgtttcacccaatcttttgtcaacgttagaaaacccttttttatggtaagtaa |
| SEQ ID NO: 137<br>Geranylgeranyl<br>pyrophosphate<br>synthase (Ai_GPPS)<br>Azadirachta indica | MLFSRGLSRISRIPRNSLIGCRWLVSYRPDTILSGSSHSVGDSTQKVLGC<br>REAYLWSLPALHGIRHQIHQQSSSLIEEELDPFSLVADELSLVANRLRS<br>MVVAEVPKLASAAEYFFKMGVEGKRFRPTVLLLMASALNVQVPQPLS<br>DGVGDALTTELRTRQQCIAEITEMIHVASLLHDDVLDDADTRRGIGSL<br>NFVMGNKLAVLAGDPFLLSRACVALASLKNTEVVSLLATVVEHLVTGE<br>TMQMTTTAEQRRSMDYYMQKTYYKTASLISNSCKAIALLAGQTTEVA<br>MLAFDYGKNLGLAFQLIDDVLDFTGTSASLGKGSLSDIRHGIVTAPILF<br>AMEEFPELRKVVDKGFDDPSNVDIALEYLGKSRGIQRTRELAQKHANL<br>ATVALDSLPESNDDDVKKSRRALLDLAQRVITRNK* |
| SEQ ID NO: 138<br>Artificial<br>geranylgeranyl<br>pyrophosphate<br>synthase (Ai_GPPS)<br>nucleotide sequence | atgttgttttccagaggtttatctcgtatttccagaatcccacgtaactctttgatcggttgtagatggttagtttctta<br>ccgtcctgataccatttttatctggttcctctcactccgttggtgactactactcaaaaggttttaggttgtcgtgaagctt<br>acttgtggtctttaccagccttgcacggtattagacaccaaattcatcaacaatcctcttctttgattgaagaagaattg<br>gatccattctctcttttagttgctgatgaattgtctttagtcgctaaccgtttgagatccatggtcgtcgctgaagtcccaaa<br>attagcctccgccgccgagtacttcttcaagatgggtgttgagggtaagagattccgtccaactgtcttattgttgatg<br>gcctccgccttaaacgttcaagtcccacaacctttgtctgacggtgttggtgatgcttttgactaccgagttgagaac<br>tagacaacaatgcattgctgagattactgaaatgatccatgttgcttcttttgttgcatgacgacgttttggatgatgct<br>gacactagacgtggtatcggttctttggaacttcgtcttatgggtaacaagttggctgtcttggctggtgatttcttgttgtc<br>cagagcctgtgttgcttttagcttcctttgaagaatactgaggttgtctcttttgttggccaccgttgttgaacacttggtc<br>accggtgaaactatgcaaatgactactactgctgaacaaagacgttccatggattattacatgcaaaagacttact<br>ataagaccgcctcttttgatttccaactcttgtaaagccattgccttgttagctggtcaaactaccgaagttgctatgtt<br>ggctttcgattacggtaagaatttgggtttagcttttcaattgatcgatgacgtcttggattttactggtacctctgcttc<br>tttaggtaaaggttccttgtctgatattagacacggtatcgttaccgctccaattttattcgctatggaagaattccca |

TABLE 1-continued

Amino acid and nucleotide sequences of the disclosure

| SEQ ID | SEQUENCE |
|---|---|
| | gaattaagaaaggttgttgataagggttttgacgacccttccaacgttgacattgctttggagtatttgggtaagtct<br>agaggtattcaaagaaccagagaattggctcaaaaacatgccaatttggccaccgtcgccttggattcttaccag<br>aatccaacgacgacgatgttaagaagtctcgtagagctttattggacttggctcaaagagttattactagaaacaa<br>gtaa |
| SEQ ID NO: 139<br>Truncated<br>geranylgeranyl<br>pyrophosphate<br>synthase<br>Es_GPPS_NTrunc | MRRSGSATAAAAATLARHANACCRARSPALGLLPGAAASSSTHRAAL<br>SSNSGHGGDGSGHYDAAMRRRESCASRSRHRWSGQEAAAASATTTT<br>ARRAPGGVAGASGQGSAAGSVRALSSSFLADAVRETATNHCIDRVVN<br>GGLDGSVPVDKDTPTVEVQDFVYDIDFAQRPSGASQSLADGPDPFELV<br>SAELAGLSDGIKSLIGTEHAVLNAAAKYFFELDGGKKIRPTMVILMSQA<br>CNSNSQQVRPDVQPGTELVNPLQLRLAEITEMIHAASLFHDDVIDEADT<br>RRGVPSVNKVFGNKLAILAGDFLLARSSMSLARLRSLESVELMSAAIE<br>HLVKGEVLQMRPTEDGGGAFEYYVRKNYYKTGSLMANSCKASAVLG<br>QHDLEVQEVAFEYGKRVGLAFQLVDDILDFEGNTFTLGKPALNDLRQ<br>GLATAPVLLAAEQQPGLAKLISRKFRGPGDVDEALELVHRSDGIARAK<br>EVAVVQAEKAMSAILTLHDSPAQNALVQLAHKIVNRNH* |
| SEQ ID NO: 140<br>Truncated<br>geranylgeranyl<br>pyrophosphate<br>synthase<br>Es_GPPS_NTrunc | atgcgtagatccggttccgctaccgccgctgccgctgccacctagccagacacgccaacgcctgttgtagagc<br>ccgttcccagctttaggtttgttgcctggtgccgccgcttcttcctctactcacagagccgccttgtcttctaattct<br>ggtcatggtggtgatggtccggtcattacgacgctgctatgagaagaagagaatcttgcgcttccagatctcgtc<br>acagatggtccggtcaagaagctgccgccgcctccgccactaccaccacctcgtcgtgctccaggtggtgt<br>cgccggtgcttctggtcaaggttctgctgccggttctgttagagcttaatcctcttcttttttagccagtgccgttcgtg<br>aaaccgctactaaccactgtatcgaccgttgtgtcaacggtggtttggacggttctgtcccagtcgataaagatac<br>cccaactgtcgaagttcaagactttgtttatgatattgactttgctcaacgtccatccggtgcctctcaatctttagctg<br>acggtccagatccattcgagttagtttccgctgagttggccggttctgtctgatggtattaagtcttttgattggtaccga<br>acatgctgtcttgaacgccgccgccaaatattttcttcgaattagatggtggtaaaaagatcagacctactatggttat<br>cttaatgtcccaagcttgtaactctaattcccaacaagttcgtcctgacgttcaaccaggtactgaattagtcaatcct<br>ttgcaattaagattggctgaaatcaccgagatgattcatgctgcttctttattccacgacgatgttattgatgaggctg<br>atactagacgtggtgtcccttctgttaataaagttttcggtaacaaattagccatcttggccggtgacttcttattggct<br>agatcctctatgtccttggcccgtttaagatccttggagtccgtcgaattgatgtccgcgctatcgaacacttggtc<br>aaaggtgaagttttacaaatgcgtccaactgaggacggtggtggtgcttcgagtactacgtcagaaaaaattact<br>acaagactggttctttgatggctaactcctgtaaggcctccgccgtttaggtcaacacgacttagaagtccaaga<br>ggtcgcttttgaatacggtaagagagtcggtttggcctttccaattggttgacgatattttagattttgaaggtaatactt<br>tcactttgggtaagccagctttaaacgacttgagacaaggtttagccactgccctgtcttgttagctgctgaacaa<br>caacctggtttagctaaattgatctccagaaagtttagaggtcctggtgatgtcgatgaagctttggaattggtcca<br>cagatccgacggtattgctagagctaaggaggttgctgttgtccaagccgaaaaagctatgtctgccattttgacc<br>ttgcatgactcccagctcaaaatgctttggttcaattggctcacaaaatcgtcaatcgtaaccattag |
| SEQ ID NO: 141<br>Geranylgeranyl<br>pyrophosphate<br>synthase (Si_GPPS)<br>Solanum sp. | MIFSKGLAQISRNRFSRCRWLFSLRPIPQLHQSNHIHDPPKVLGCRVIHS<br>WVSNALSGIGQQIHQQSTAVAEEQVDPFSLVADELSLLTNRLRSMVVA<br>EVPKLASAAEYFFKLGVEGKRFRPTVLLLMATALNVQIPRSAPQVDVD<br>SFSGDLRTRQQCIAEITEMIHVASLLHDDVLDDADTRRGISGSLNFVMG<br>NKLAVLAGDFLLSRACVALASLKNTEVVCLLATVVEHLVTGETMQMT<br>TSSDERCSMEYYMQKTYYKTASLISNSCKAIALLAGHSAEVSVLAFDY<br>GKNLGLAFQLIDDVLDFTGTSATLGKGSLSDIRHGIVTAPILYAMEEFP<br>QLRTLVDRGFDDPVNVEIALDYLGKSRGIQRTRELARKHASLASAAID<br>SLPESDDEEVQRSRRALVELTHRVITRTK* |
| SEQ ID NO: 142<br>Artificial<br>geranylgeranyl<br>pyrophosphate<br>synthase (Si_GPPS)<br>nucleotide sequence | atgatcttttccaagggtttagctcaaatctctcgtaatagattctctcgttgcagatggttattctcttgcgtccaat<br>tcctcaattacaccaatccaatcacatccacgacccaccaaaagttttgggttgtcgtgtcattcactcttgggtttcta<br>atgccttgtctggtatcggtcaacaaatccatcaacaatctactgccgttgccgaggaacaagtcgaccctttttcttt<br>ggttgctgatgagttatccttgttaaccaacagattgagatccatggttgtcgctgaagtccctaagttagcctccgc<br>cgctgagtatttctttaagttaggtgtcgaaggtaaacgttttccgtccaactgtcttgttgttgatggccactgcctta<br>aacgtccaaattcctcgttctgctccacaagttgacgttgactcttttttctggtgacttgagaactagacaacaatgta<br>tcgctgaaattactgaaatgattcacgtcgctcttgttgcatgatgacgtcttagatgatgctgatactagaagag<br>gtattggttcccttaaattttgttatgggtaataagttggctgttttggctggtgatttcttgttatccagagcctgcgtcg<br>ccttagcctccttgaagaacaccgaagttgtctgtttattggccactgttgtcgaacatttggttaccggtgaaacta<br>tgcaaatgactacctcctccgatgaaagatgttccatggaatactacatgcaaaagacctactataagactgcctct<br>ttgatttctaactcttgtaaagccattgccttgttagccggtcactctgctgaagttttctgtcttggccttcgattacggt<br>aagaacttaggtttggcttttcaattgatcgacgatgttttggacttcaccggtacctctgctacttttgggtaaaggtt<br>ccttgtccgatatcagacatggtatcgttactgctcctattttgtatgctatgaagaattccctcaattacgtactttg<br>gttgacagagggtttcgatgatccagttaatgttgagatcgctttggattactgggtaaatcccgtggtattcaaaga<br>actagagaattagccagaaagcatgcctcttagcctctgccgccatcgattccttgcctgaatccgacgatgagg<br>aagttcaaagatctcgtagagctttggtcgaattgacccatagagtcattactcgtactaagtaa |
| SEQ ID NO: 143<br>Geranylgeranyl<br>pyrophosphate<br>synthase Hb_GPPS<br>Hevea brasiliensis | MQFLRGLSPISRSGLRLFLSRQLYPFPVANSSQLLGDSTQKVFNRRETY<br>SWSLVDSHGFKQQIHHQSSFLSEEPLDPFSLVADELSLVANRLRAMLVS<br>EVPKLASAAEYFFKMGVEGKRLRPTVLLLMATALNVHIHEPMPNGVG<br>DTLGAELRTRQQCIAEITEMIHVASLLHDDVLDDADTRRGIGSLNFVM<br>GNKVAVLAGDFLLSRACVALASLKNTEVVSLLATVVEHLVTGETMQ<br>MTSTSEQRCSMDHYMQKTYYKTASLISDSCKAIALLAGQTTEVAMLA<br>FEYGKSLGLAFQLIDDVLDFTGTSASLGKGSLSDIRHVIRLSLI* |
| SEQ ID NO: 144<br>Artificial<br>geranylgeranyl | atgcaattttgagaggtttgtcccctatttccagatccggtttgcgtttattcttatctcgtcaattatatccattccca<br>gtcgccaactcctcccaattattaggtgactctactcaaaaggtttttaacagacgtgagacttactcttggtcttgt<br>cgactctcacggttttaagcaacaaattcatcaccaatcctcttttttgtctgaagaaccattggatccattctctttgg |

TABLE 1-continued

Amino acid and nucleotide sequences of the disclosure

| SEQ ID | SEQUENCE |
|---|---|
| pyrophosphate synthase (Hb_GPPS) nucleotide sequence | ttgctgatgaattatccttggtcgctaacagattgcgtgctatgttggtttctgaagtcccaaaattagcctccgccg ctgaatatttttcaagatgggtgttgaaggtaagagattgcgtccaaccgtcttgttattaatggccactgctttaaa cgttcatatccatgaacctatgcctaacggtgttggtgacactttgggtgccgaattgagaactagacaacaatgc atcgctgaaatcaccgaaatgatccatgttgcttctttattacatgacgacgttttagacgatgccgataccagaag aggtattggttctttgaacttcgttatgggtaacaaggttgctgttttggccggtgacttttttgttgtccagagcttgtgt tgccttagcttctttgaagaataccgaagtcgtttctttattggccaccgtcgtcgaacacttggttactggtgagact atgcaaatgacctccacttctgagcaacgttgttccatggatcattatatgcaaaagacttactataagaccgcttcc ttaatctctgattcctgtaaagccatcgccttgttagctggtcaaactaccgaggtcgccatgttggccttcgaatat ggtaagtcttttgggttttagcttttcaattaatcgacgatgttttttagacttcaccggtacttctgcttccttgggtaaggg ttcttttgtccgacattagacacgttattagattatccttaatttaa |
| SEQ ID NO: 145 Mutant medium-chain fatty acid CoA ligase Ec_FADK_v1 | MHPTGPHLGPDVLFRESNMKVTLTFNEQRRAAYRQQGLWGDASLAD YWQQTARAMPDKIAVVDNHGASYTYSALDHAASCLANWMLAKGIES GDRIAFQLPGWCEFTVIYLACLKIGAVSVPLLPSWREAELVWVLNKCQ AKMFFAPTLFKQTRPVDLILPLQNQLPQLQQIVGVDKLAPATSSLSLSQI IADNTSLTTAITTHGDELAAVLFTSGTEGLPKGVMLTHNNILASERAYC ARLNLTWQDVFMMPAPLGHATGFLHGVTAPFLIGARSVLLDIFTPDAC LALLEQQRCTCMLGATPFVYDLLNVLEKQPADLSALRFFLCGGTTIPK KVARECQQRGIKLLSVYGSTESSPHAVVNLDDPLSRFMHTDGYAAAG VEIKVVDDARKTLPPGCEGEEASRGPNVFMGYFDEPELTARALDEEG WYYSGDLCRMDEAGYIKITGRKKDIIVRGGENISSREVEDILLQHPKIH DACVVAMSDERLGERSCAYVVLKAPHHSLSLEEVVAFFSRKRVAKYK YPEHIVVIEKLPRTTSGKIQKFLLRKDIMRRLTQDVCEEIE* |
| SEQ ID NO: 146 Artificial medium-chain fatty acid CoA ligase Ec_FADK_v1 nucleotide sequence | atgcatccaactggtccacacttaggtcctgatgtcttattcagagaatctaatatgaaagtcactttgacctttaatg aacaaagacgtgccgcttacagacaacaaggtttgtggggtgacgcttcttggctgactactggcaacaaactg ctagagctatgccagacaagatcgccgttgtcgataaccacggtgcttcttataccactctgctttggatcatgcc gcttcttgtttggctaattggatgttggctaagggtatcgaatctggtgatcgtattgcttttcaattgccaggttggtg tgaatttaccgttatctacttggcttgtttgaagattggtgctgtttctgtcccattgttgccatcttggagagaagccg aattggtttgggttttgaacaaatgccaagctaagatgttctttgctccaaccttgttcaagcaaactagaccagttg acttgattttaccttttacaaaatcaattaccacaattgcaaccaaatcgttggtgttgacaagttagctccagccacctc ctctttgtccttgtcccaaatttatcgctgataatacttctttaaccaccgctatcactactcacggtgatgagttggctg ctgtttttgttcacttccggtactgagggtttgccaaagggtgttatgttgacccacaataacatttggcttccgaaag agcttattgtgctcgtttgaacttgacctggcaagtgttttcatgatgccagctccattgggtcatgctactggtttct tgcacggtgttactgcccccattcttgattggtgctagatctgtcttgttggatatcttatacccagacgcttgcttagct ttattggaacaacaaagatgtacctgtatgttaggtgctactccattttgtttacgatttattgaacgttttggaaaaaca accagctgatttgtctgccttgagattctttttgtgtggtggtactactattccaaagaaagttgctagagaatgccaa caaagagtatcaagttgttgtccgtctatggttcactgaatcttctcctcaatgctgttgtcaattagtgacccatt gtctagattcatgcacaccgatggtacgccgctgctggtgttgagattaaggttgtcgacgatgctagaaagacc ttacctccaggttgtgaaggtgaagaagcctctagaggtccaaatgtctttatgggttacttcgacgagccagaatt gactgctagagcttagatgaggaaggttggtattactctggtgatttgtgtagaatggatgaagctggttacattaa aatcactggtagaaagaaggacattattgttagaggtggtgaaaatatcctcccagagaagttgaagatattttatt gcaacacccaaagattcatgatgcttgtgttgttgctatgtccgatgagagattaggtgaaagatcttgtgcttacgt tgttttgaaggctccacatcactctttgtctttagaagaagtcgttgctttcttctctagaaagagagtcgccaagtac aagtacccagaacacattgttgttatcgaaaaattgcctagaactacttctggtaaaattcaaaaattcttgttgaga aaggatatcatgagacgtttgacccaagatgtctgtgaagaaattgaataa |
| SEQ ID NO: 147 Medium-chain fatty acid CoA ligase Ec_FADK_v2 Escherichia coli | MHPTGPHLGPDVLFRESNMKVTLTFNEQRRAAYRQQGLWGDASLAD YWQQTARAMPDKIAVVDNHGASYTYSALDHAASCLANWMLAKGIES GDRIAFQLPGWCEFTVIYLACLKIGAVSVPLLPSWREAELVWVLNKCQ AKMFFAPTLFKQTRPVDLILPLQNQLPQLQQIVGVDKLAPATSSLSLSQI IADNTSLTTAITTHGDELAAVLFTSGTEGLPKGVMLTHNNILASERAYC ARLNLTWQDVFMMPAPLGHATGFLHGVTAPFLIGARSVLLDIFTPDAC LALLEQQRCTCMLGATPFVYDLLNVLEKQPADLSALRFFLCGGTTIPK KVARECQQRGIKLLSVYGSTESSPHAVVNLDDPLSRFMHTDGYAAAG VEIKVVDDARKTLPPGCEGEEASRGPNVFMGYFDEPELTARALDEEG WYYSGDLCRMDEAGYIKITGRKKDIIVRGGENISSREVEDILLQHPKIH DACVVAMSDERLGERSCAYVVLKAPHHSLSLEEVVAFFSRKRVAKYK YPEHIVVIEKLPRTTSGKIQKFLLRKDIMRRLTQDVCEEIE* |
| SEQ ID NO: 148 Artificial medium-chain fatty acid CoA ligase Ec_FADK_v2 nucleotide sequence | atgcatccaactggtcctcacttaggtccagatgtcttattcagagaatctaacatgaaagtcactttaacttttaacg aacaacgtagagctgcttatagacaacaaggtttgtggggtgatgcttcttggctgactactggcaacaaactgc tagagccatgccagataaaattgccgttgttgacaatcacggtgcttcttacacttattctgccttagatcacgctgc ttcctgtttagctaactggatgttagctaagggtattgaatccggtgataagaattgcttttccaattgccaggttggtgc gaatttactgtcatttatttagcttgtttaaagattggtgccgtctccgtcccttttgttgccatcctgagagaggccg agttggtttgggttttaaacaagtgtcaagctaaaatgttctttgctcctaccttgttcaagcaaaccagaccagttga cttaattttgccattacaaaaccaattaccacaattgcaacaaatcgtcggtgttgacaaaattagctccagccacttct tctttgtccttatcccaaatttattgctgataacacttctttaactactgctattactactcacggtgatgaattggccgct gttttgttcacttccggtactgaaggtttgcctaaaggtgtcatgttgactcacaacaacattttggcctctgaaaga gcttactgtgcccgtttaaatttgacctggcaagatgtcttcatgatgcctgctccattgggtcacgctaccggtttctt acacggtgtactgcccccattcttgatcggtgctcgtcttctgtttattggatatctttcaccaggtctgcttagctc tattggaacaacaaagatgtacctgcatgttaggtgctactcctttcgtctatgattttattgaacgtcttagaaaacaa ccagctgatttatccgctttaagattctttttgtgtggtggtactactatcccaaaaaaggtcgccagagaatgtcaa caaagaggtattaaattattgtccgtttatggttccactgaatcttcccctcatgctgttgtcaatttagacgacccttt gtccagattcatgcacactgatggtacgccgctgctggtgtcgaaatcaaggttgttgatgacgctagaaaaact ttaccacctggttgcgaaggtgaagaggcttccagaggtccaaacgtctttatgggttactttgatgaaccagaatt |

TABLE 1-continued

Amino acid and nucleotide sequences of the disclosure

| SEQ ID | SEQUENCE |
|---|---|
| | gactgccagagctttggatgaggaaggttggtattattctggtgatttgtgtagaatggatgaagccggttacatca<br>agatcaccggtagaaagaaagacatcatcgttagaggtggtgaaaacatttcttctagagaagttgaagacatttt<br>gttgcaacacccaaagatccacgacgcttgtgtcgtcgccatgtctgacgaaagatgggtgaacgttcttgtgct<br>tacgtcgtcttgaaagccccacaccactctttgtctttggaagaagtcgttgcttttttctctcgtaagcgtgttgcca<br>agtacaagtacccagagcacatcgttgttattgaaaaattgcctcgtactacttccggtaagattcaaaagttcttatt<br>acgtaaggacatcatgagaagattgactcaagacgtctgcgaagaaattgaataa |
| SEQ ID NO: 149<br>Truncated acyl<br>activating enzyme<br>(Cs_AAE3_Ctrunc) | MEKSGYGRDGIYRSLRPPLHLPNNNNLSMVSFLFRNSSSYPQKPALIDS<br>ETNQILSFSHFKSTVIKVSHGFLNLGIKKNDWLIYAPNSIHFPVCFLGIIA<br>SGAIATTSNPLYTVSELSKQVKDSNPKLIITVPQLLEKVKGFNLPTILIGP<br>DSEQESSSDKVMTFNDLVNLGGSSGSEFPIVDDFKQSDTAALLYSSGTT<br>GMSKGWLTHKNFIASSLMVTMEQDLVGEMDNVFLCFLPMFHVFGLAI<br>ITYAQLQRGNTVISARFDLEKMLKDVEKYVTHLWWPPVILALSKNSM<br>VKFNLSSIKYIGSGAAPLGKDLMEECSKWPYGIVAQGYGMTETCGIVS<br>MEDIRGGKRNSGSAGMLASGVEAQIVSVDTLKPLPPNQLGEIWVKGPN<br>MMQGYFNNPQATKLTIDKKGWVHTGDLGYFDEDGHLYWDRIKELIK<br>YKGFQVAPAELEGLLVSHPEILDAWIPFPDAEAGEVPVAYWRSPNSSL<br>TENDVKKFIAGQVASFKRLRKVTFINSVPKSASGKIL |
| SEQ ID NO: 150<br>Truncated acyl<br>activating enzyme<br>(Cs_AAE3_Ctrunc) | atggaaaaatctggttatggtagagacggtatctacagatccttgcgtcctccattacacttgccaaacaataataa<br>cttatctatggttttccttttgttccgtaactcttcctcttacccacaaaaacctgcttttgactcgaaaccaatca<br>aatcttgtccttttcccacttcaaatctactgtcattaaagtctctcacggttcttgaacttaggtattaagaagaacg<br>actggttgatctacgctcctaattccatccacttttccagtttgttcttgggtatcattgcttcctggtgccattgctacca<br>cttctaaccctttatacactgtttctgagttatctaagcaagttaaagattctaacccaaaattgattatcactgtccca<br>caattattagaaaaggtcaaggttcaatttaccaaccattttaatcggtccagactccgaacaagagtcttcttcc<br>gataaagttatgactttaacgacttagttaactgggtggttcttctggttctgagttcccaatcgtcgatgatttcaa<br>gcaatctgacaccgccgctttattgtattcctctggtactactggtatgtctaagggttggttgactcacaaaaacttt<br>atcgcttcctcttgatggttaccatggaacaagacttggttggtgaaatggataacgtcttcttgtgttttttaccaat<br>gttccatgttttcggtttagctatcattacttacgctcaattacaaagaggtaacactgtcatctctgctcgttttgactt<br>agaaaagatgttgaaagacgttgaaaagtacgttactcacttgtggtggcctcctgttatttagctttgtctaagaat<br>tctatggttaaattcaacttgtcctctatcaagtacattggttctggtgccgctccattaggtaaggacttgatggaag<br>aatgttctaaatgcctttacggtatcgtcgctcaaggttacggtatgactgaacttgtggtatcgtttctatggaag<br>acatcagaggtggtaagcgtaactccggttctgctggtatgttggcttccggtgttgaagcccaaattgtttctgtc<br>gatactttgaaaccttgccacctaaccaattaggtgaaatttgggttaaaggtcctaacatgatgcaaggttacttc<br>aataaccctcaagctactaagttaactattgataagaagggttgggttcatactggtgatttgggttacttcgatgaa<br>gatggtcatttgtactgggatagaatcaaagaattaattaagtataaaggtttccaagttgccccagctgaattgga<br>aggtttgttggtttctcatcctgaaattttagatgcttggattcctttcccagacgctgaagccggtgaagttccagtt<br>gcttactggagatcccctaactcttccttgactgaaaacgacgtcaagaagttcatcgctggtcaagttgcttcctt<br>aagagattaagaaaagtcaccttcatcaactccgttccaaagtctgcttccggtaagattttg |
| SEQ ID NO: 151<br>Truncated<br>cannabidiolic acid<br>synthase<br>Cs_CBDASt28 | MSNPRENFLKCFSQYIPNNATNLKLVYTQNNPLYMSVLNSTIHNLRFTS<br>DTTPKPLVIVTPSHVSHIQATILCSKKVGLQIRTSGGHDSEGMSYISQV<br>PFVIVDLRNMRSIKIDVHSQTAWVEAGATLGEVYYWVNEKNENLSLA<br>AGYCPTVCAGGHFGGGGYGPLMRNYGLAADNIIDAHLVNVHGKVLD<br>RKSMGEDLFWALRGGGAESFGIIVAWKIRLVAVPKSTMFSVKKIMEIH<br>ELVKLVNKWQNIAYKYDKDLLLMTHFITRNITDNQGKNKTAIHTYFSS<br>VFLGGVDSLVDLMNKSFPELGIKKTDCRQLSWIDTIIFYSGVVNYDTD<br>NFNKEILLDRSAGQNGAFKIKLDYVKKPIPESVFVQILEKLYEEDIGAG<br>MYALYPYGGIMDEISESAIPFPHRAGILYELWYICSWEKQEDNEKHLN<br>WIRNIYNFMTPYVSKNPRLAYLNYRDLDIGINDPKNPNNYTQARIWGE<br>KYFGKNFDRLVKVKTLVDPNNFFRNEQSIPPLPRHRH* |
| SEQ ID NO: 152<br>Truncated<br>cannabidiolic acid<br>synthase<br>Cs_CBDASt28 | atgtctaatccaagagagaatttcttaaagtgtttttctcaatacatcccaaacaatgctactaacttaaagttggttta<br>cactcaaaataaccattgtacatgtctgtcttgaactctaccattcacaatttgcgttttacttctgacaccaccccta<br>agccattagttattgttaccccatcccacgtctctcacatccaaggtactattttgtgttctcaaaaaggttggtttgcaa<br>attagaactagatctggtggtcacgactccgagggtatgtcttacatctctcaagttccattcgttattgtcgacttgc<br>gtaacatgcgttccatcaaatcgatgttcactcccaaactgctgggtcgaagccggtgccacttaggtgaggt<br>ttattactgggtcaatgagaagaatgagaatttgtccttggctgctggttattgtccaaccgtctgtgctggtggtcat<br>tttggtggtggtggttacggtccattaatgagaaactattggtttggctgccgataacattatcgacgctcacttggt<br>aatgtccacgtaaggtcttagatagaaaatccatgggtgaggacttgttctgggctttgagaggtggtggtgctg<br>agtcctttgctatcatccttgcttggaaaattcgtttagttcctgtcccaaaatctactatgttttctgttaagaagatca<br>tggaaattcacgagttggttaagtggttaataagtggcaaaatattgcctacaagtatgacaaagacttgttattga<br>tgactcacttcatcactagaaacatcaccgataaccaaggtaaaaataaaactgctatccatacctacttctcctcc<br>gttttcttgggtggtgtcgactcccttagtgattgatgaacaaatctttcctgaattaggtatcaagaagactgattgt<br>cgtcaattgtcctggattgataccattatctttttactctggtgtcgtcaattacgacaccgataatttcaataaggaaat<br>tttattggacagatctgccggtcaaaacggtgctttcaagatcaagttggactacgttaaaaaaccaatcccagaat<br>ccgtcttctccaaatttggagaagttatacgaggaagacatcggtgctggtatgtatgcctatatccatacggtg<br>gtattatggatgaaatttccgaatctgctatccctttcccacatcgtgctggtattttgtatgaattatgctacatttgt<br>tcctgggaaaagcaagaagataacgagaagcacttgaattggatcagaaatatctacaatttcatgactccttacgttt<br>ctaagaatcctcgtttggcttacttgaactacagagatttggacatcggtattaatgacccaaagaacccaaataac<br>tatactcaagctagaatttgggtgaaaagtacttcggtaaaaactttgacagattggttaaggttaagactttagtt<br>gatccaaataacttcttcagaaatgaacaatccatcccaccattgcctagacacagacactaa |
| SEQ ID NO: 153<br>Truncated<br>tetrahydro | MSNPRENFLKCFSKHIPNNVANPKLVYTQHDQLYMSILNSTIQNLRFIS<br>DTTPKPLVIVTPSNNSHIQATILCSKKVGLQIRTSGGHDAEGMSYISQV<br>PFVVVDLRNMHSIKIDVHSQTAWVEAGATLGEVYYWINEKNENLSFP |

TABLE 1-continued

Amino acid and nucleotide sequences of the disclosure

| SEQ ID | SEQUENCE |
|---|---|
| cannabinolic acid synthase Cs_THCASt28 | GGYCPTVGVGGHFSGGGYGALMRNYGLAADNIIDAHLVNVDGKVLD RKSMGEDLFWAIRGGGGENFGIIAAWKIKLVAVPSKSTIFSVKKNMEIH GLVKLFNKWQNIAYKYDKDLVLMTHFITKNITDNHGKNKTTVHGYFS SIFHGGVDSLVDLMNKSFPELGIKKTDCKEFSWIDTTIFYSGVVNFNTA NFKKEILLDRSAGKKTAFSIKLDYVKKPIPETAMVKILEKLYEEDVGAG MYVLYPYGGIMEEISESAIPFPHRAGIMYELWYTASWEKQEDNEKHIN WVRSVYNFTTPYVSQNPRLAYLNYRDLDLGKTNHASPNNYTQARIWG EKYFGKNFNRLVKVKTKVDPNNFFRNEQSIPPLPPHHH* |
| SEQ ID NO: 154 Truncated tetrahydrocannabinolic acid synthase Cs_THCASt28 | atgtctaaccctcgtgagaacttcttgaaatgtttctccaaacatatcccaaacaatgtcgctaaccctaagttagttt acactcaacatgatcaattatatatgtctatcttgaactctaccatccaaaacttgagattcatctccgataccacccc aaaaccattggttattgttaccccatccaacaattctcatattcaagctaccattttgtgctccaaaaaggtcggtttg caaatccgtactagatctggtggtcacgatgctgaaggtatgtcttacatttcccaagtcccattcgttgttgtcgatt taagaaatatgcactctatcaaaatcgacgttcactctcaaactgcttgggttgaagccggtgccactttaggtgag gtttactactggattaacgaaaagaatgaaaacttatccttcccaggtggttactgtccaactgttggtgttggtggtc acttctctggtggtggttatggtgccttgatgagaaactacggtttagctgctgataatattatcgacgctcacttggt taatgtcgacggtaaggttttggacagaaaatccatgggtgaagatttattctgggccattagaggtggtggtggt gaaaacttcggtatcattgctgcttggaaaattaaattggtcgctgtcccatccaagtctactattttctccgtcaaga aaaacatggaaattcatggtttggttaaattattcaacaagtggcaaaacattgcttacaaatacgacaaagactta gttttgatgacccacttcattactaaaaacattaccgacaaccatggtaaaaataaaactactgttcacggttacttct cttccattttcatggtggtgtcgactccttggtcgatttaatgaacaaatcttccctgagttgggtatcaagaagac cgactgtaaagaattctcttggatcgacactactattttctactctggtgtcgttaacttcaacaccgctaatttcaaga aggaaatttttattagatagatccgctggtaaaaagaccgcttctctatcaaattagactacgttaaaaaaccaatcc cagaaaccgctatggtcaaatcttggaaaaattatatgaagaagacgttggtgccggtatgtacgtcttatatccca tatggtggtattatggaagagatctctgaatccgctatccctttccacacagagccggtattatgtacgaattatgg tacactgcttcctgggagaaacaagaagataatgaaaagcacattaactgggttagatctgtttacaacttcactac tccatacgtctctcaaaacccaagattagcctacttaaactaccgtgatttggattaggtaaaactaatcacgcttc cccaaacaactacacccaagctgaaatttggggtgagaagtactttggtaagaacttcaaccgtttagtcaaggtc aagactaaagttgatccaaacaatttttttcagaaacgaacaatctatcccacctttaccaccacaccaccattag |
| SEQ ID NO: 155 GenBank AB057805.1 Tetrahydro cannabinolic acid synthase (THCAS, Cs_THCAS_full) *Cannabis sativa* | MNCSAFSFWFVCKIIFFFLSFHIQISIANPRENFLKCFSKHIPNNVANPKL VYTQHDQLYMSILNSTIQNLRFISDTTPKPLVIVTPSNNSHIQATILCSKK VGLQIRTRSGGHDAEGMSYISQVPFVVVDLRNMHSIKIDVHSQTAWVE AGATLGEVYYWINEKNENLSFPGGYCPTVGVGGHFSGGGYGALMRN YGLAADNIIDAHLVNVDGKVLDRKSMGEDLFWAIRGGGGENFGIIAA WKIKLVAVPSKSTIFSVKKNMEIHGLVKLFNKWQNIAYKYDKDLVLM THFITKNITDNHGKNKTTVHGYFSSIFHGGVDSLVDLMNKSFPELGIKK TDCKEFSWIDTTIFYSGVVNFNTANFKKEILLDRSAGKKTAFSIKLDYV KKPIPETAMVKILEKLYEEDVGAGMYVLYPYGGIMEEISESAIPFPHRA GIMYELWYTASWEKQEDNEKHINWVRSVYNFTTPYVSQNPRLAYLN YRDLDLGKTNHASPNNYTQARIWGEKYFGKNFNRLVKVKTKVDPNN FFRNEQSIPPLPPHHH* |
| SEQ ID NO: 156 Artificial Tetrahydrocannabinolic acid synthase Cs_THCAS_full nucleotide sequence | atgaattgttctgctttctctttctggttcgtttgtaagatcatcttttttcttcttatcttccatattcaaatctctatc gctaaccctcgtgagaacttcttgaaatgtttctccaaacatatcccaaacaatgtcgctaaccctaagttagtttacact caacatgatcaattatatatgtctatcttgaactctaccatccaaaacttgagattcatctccgataccaccccaaaacc attggttattgttaccccatccaacaattctcatattcaagctaccattttgtgctccaaaaaggtcggttgcaaatcc gtactagatctggtggtcacgatgctgaaggtatgtcttacatttcccaagtcccattcgttgttgtcgatttaagaaa tatgcactctatcaaaatcgacgttcactctcaaactgcttgggttgaagccggtgccactttaggtgaggtttacta ctggattaacgaaaagaatgaaaacttatccttcccaggtggttactgtccaactgttggtgttggtggtcacttctct ggtggtggttatggtgccttgatgagaaactacggtttagctgctgataatattatcgacgctcacttggttaatgtc gacggtaaggttttggacagaaaatccatgggtgaagatttattctgggccattagaggtggtggtggtgaaaact tcggtatcattgctgcttggaaaattaaattggtcgctgtcccatccaagtctactattttctccgtcaagaaaaacat ggaaattcatggtttggttaaattattcaacaagtggcaaaacattgcttacaaatacgacaaagacttagttttgat gacccacttcattactaaaaacattaccgacaaccatggtaaaaataaaactactgttcacggttacttctcttccatt tttcatggtggtgtcgactccttggtcgatttaatgaacaaatcttccctgagttgggtatcaagaagaccgactgt aaagaattctcttggatcgacactactattttctactctggtgtcgttaacttcaacaccgctaatttcaagaaggaaa ttttattagatagatccgctggtaaaaagaccgcttctctatcaaattagactacgttaaaaaaccaatcccagaaa ccgctatggtcaaatcttggaaaaattatatgaagaagacgttggtgccggtatgtacgtcttatatcccatatggtg gtattatggaagagatctctgaatccgctatcccttttccacacagagccggtattatgtacgaattatggtacactg cttcctgggagaaacaagaagataatgaaaagcacattaactgggttagatctgtttacaacttcactactccatac gtctctcaaaacccaagattagcctacttaaactaccgtgatttggattaggtaaaactaatcacgcttcccccaaac aactacacccaagctgaaatttggggtgagaagtactttggtaagaacttcaaccgtttagtcaaggtcaagacta aagttgatccaaacaatttttttcagaaacgaacaatctatcccacctttaccaccacaccaccattag |
| SEQ ID NO: 157 Artificial Erg10p: acetoacetyl CoA thiolase nucleotide sequence | atgtcccaaaatgtttacattgttctactgctagaactcctatcggttccttccaaggttccttatcttccaaaactgcc gtcgaattgggtgccgttgccttgaaaggtgcttagctaaagttccagagttagacgcttccaaagatttcgatga aattctcttcggtaacgttttatccgctaacttgggtcaagctccagcagacaagttgcctggctgccggttgtc taatcacatcgttgcttctactgctcaacaaagtttgtgcctctgctatgaaagctatcatttaggtgcccaatctatta aatgtggtaatgctgacgttgttgtcgctggtggttgtgagtccatgaccaacgcccttactacatgccagccgc cagagccggtgccaaattcggtcaaactgttttggttgacggtgttgaaagagatggttgaacgatgcctatgac ggttggctatgggtgttcacgctgaaaagtgtgctagagactgggacattaccggagaacaacaagataatttc gctattgaatcttaccaaagtcccaaaaatctcaaaggaaggtaagtttgacaatgaaatcgttccagttactat caagggttttcgtggtaagcctgatactcaagtcaccaaggatgaagaaccagcccgtttacacgtcgaaaagtt gagatctgccagaaccgttttccaaaaagaaaacggtaccgttactgctgccaatgcttctccaatcaacgatggt gccgctgctgttattttagtctctgagaaggttttgaaggagaaaaatttgaagcctttagccatcattaagggttgg TABLE 1-continued Amino acid and nucleotide sequences of the disclosure

| SEQ ID | SEQUENCE |
|---|---|
| | ggtgaagctgctcaccaaccagctgatttcacttgggcccttctttagctgtcccaaaggctttaaaacacgctg<br>gtattgaagatatcaactctgttgactacttcgaattcaatgaagctttctctgtcgtcggtttggtcaataccaaaatc<br>ttgaagttggatccttctaaggttaacgtttacggtggtgctgtcgccttaggtcacccttaggttgttctggtgcta<br>gagttgttgtccacttgttgtccattttacaacaagaaggtggtaagatcggtgttgctgctatctgtaacggtggtg<br>gtggtgcttcttccattgtcatcgaaaagatctag |
| SEQ ID NO: 158<br>Artificial<br>mevalonate<br>pyrophosphate<br>decarboxylase<br>(Sc_ERG19)<br>nucleotide<br>sequence | atgactgtctacactgcctccgttactgccctgtcaacattgccaccttgaagtattggggtaaaagagatactaa<br>attgaacttaccaactaactcctccatttctgtcactttgtctcaagatgatttgagaaccttgacttccgctgccacc<br>gcccctgaatttgagagagatacttttgtggttaaatggtgaacctcattctattgacaacgaaagaacccaaaact<br>gtttacgtgacttgagacaattgcgtaaggaaatggaatctaaagacgcttcttttacctaccttgtctcaatggaaat<br>tgcatatcgtttctgaaaataacttccctactgctgccggtttggcttcctccgctgctggttttgctgctttagtttctg<br>ccatcgccaaattatatcaattgccacaatccacttccgaaatctctagaatcgctagaaaaggttccggttctgctt<br>gtagatccttgttcggtggttacgttgcttgggaaatgggtaaagctgaagacggtcatgattctatggccgttcaa<br>attgccgactcctccgattggctccaaatgaaagcttgtgtcttggttgtctccgatatcaaaaaggatgtctcttcta<br>ctcaaggtatgcaattaactgttgccacttccgaattgttcaaagagcgtatcgaacacgttgttccaaagagatttg<br>aagttatgagaaaagctatcgtcgaaaaggacttcgctaccttgccaaggagactatgatggattctaactccttc<br>cacgctacttgtttggattccttccaccttttctacatgaatgacacctccaaacgtattatctcttggtgtcacacc<br>attaaccaatttttatggtgaaactatcgtcgcttacactttcgatgccggtccaaacgctgtcttgtactatttggctga<br>aaacgaatccaagttatttgcttttatctataagttgttcggttccgtccctggttgggacaagaaattcaccactgaa<br>caattggaagctttcaaccaccaattcgaatcttccaatttcactgctagaaattagatttggaattacaaaaggat<br>gtcgctagagtcatcttaactcaagttggttccggtccacaagaaactaacgaatctttgattgatgctaaaactggt<br>ttgcctaaagaataa |
| SEQ ID NO: 159<br>Artificial isopentenyl<br>pyrophosphate<br>isomerase Sc_IDI1<br>nucleotide sequence | atgaccgctgacaacaactccatgccacatggtgctgtctcctcctacgctaaattagtccaaaaccaaaccctg<br>aagacattttagaagagttccctgaaatcattccattgcaacaaagaccaaacactagatcctccgagacttctaa<br>cgatgaatctggtgaaacttgttttctggtcatgatgaagaacaaatcaagttgatgaacgaagattgtattgttttg<br>gactggggatgacaacgctatcggtgctggtaccaaaaaggtctgtcacttgatggaaaacatcgaaaagggtttg<br>ttgcatagagccttttccgtcttcatcttcaacgaacaaggtgagttattattgcaacaaagagccactgaaaaaatc<br>acctttccagatttatggaccaacacctgttgctcccatccattgtgtattgatgatgaattgggtttgaaaggtaagt<br>tggacgacaagattaaaaggtgccatcaccgccgctgttcgtaagttagaccatgaattgggtatccctgaagacg<br>aaactaagactagaggtaaattccatttcttgaatcgtattcactacatggctccttccaatgaaccatggggtgaa<br>cacgaaatcgactacattttgttttacaaaattaatgctaaagaaaatttaaccgttaacccaaacgtcaacgaggtt<br>agagatttcaagtgggtctctccaaacgatttgaagactatgttcgctgacccatcctacaagttcactccatggttt<br>aagatcatctgtgaaaactatttgttttaactggtgggagcaattggacgacttatctgaagttgaaaatgatcgtcaa<br>attcaccgtatgttgtaa |
| SEQ ID NO: 160<br>Artificial<br>phosphomevalonate<br>kinase Sc_ERG8<br>nucleotide sequence | atgtccgagttaagagccttctccgctcctggtaaagccttattagctggtggttacttagtcttggatactaaatatg<br>aagccttcgtcgtcggttttatctgccagaatgcatgccgtcgcccatccatacgttccttgcaaggttctgacaag<br>tttgaggtccgtgtcaagtctaaacaattcaaagatggtgaatggttgtatcatatttctccaaaatccggtttcattcc<br>agtttctatcggtggttctaagaaccccattcatcgaaaaagtcatcgctaacgttttctcttacttcaagctaatatg<br>gatgattattgcaatagaaatttattcgttattgatatcttctccgatgacgccatcattcccaagaagactctgttac<br>cgagcatagaggtaacagaagattactttccactctcacagaattgaaggagttccaaaaactggtttaggttctt<br>ctgctggttagtcaccgttttaaccactgccttggcttcttctttgtttccgacttagaaaataacgtcgacaagtat<br>cgtgaagtcatccacaacttggcccaagttgctcattgtcaagctcaaggtaagattggttccggtttcgatgttgct<br>gccgccgcctacggttccatcagatatagaagattccctccagctttgatttctaacttaccagatattggttctgcta<br>cttatggttccaagttggctcacttggttgacgaagaagattggaacattaccatcaagtccaatcacttgccatctg<br>gtttaacttttgtggatgggtgatatcaagaacggttctgaaactgtcaaattggtccaaaaggtcaaaaattggtac<br>gattcccatatgccagagtctttgaagatctatactgaattggaccacgctaactctcgtttcatggatggtttgtcta<br>agttggacagattgcatgaaactcacgacgactactctgaccaaattttcgagtccttggaaagaaacgactgca<br>cttgtcaaaagtatccagaaatcaccgaggttagagatgccgttgctactattagaagatccttcagaaagattacc<br>aaggaatctggtgctgatattgagcctccagttcaaacttctttgttggatgattgccaaacttttaaaaggtgttttaa<br>cttgttttaattcctggtgctggtggttacgacgccatcgccgttatcaccaaacaagacgtcgacttaagagccca<br>aactgccaacgacaaaagattctccaaggttcaatggttggacgtcactcaagctgattggggtgttagaaaaga<br>aaaggacccagagacttacttggataaatag |
| SEQ ID NO: 161<br>Mutant farnesyl<br>pyrophosphate<br>synthase (Erg20mut,<br>F96W, N127W) | atggcttctgagaaggagattcgtcgtgagagattcttgaatgttttcctaaattagtcgaggaattgaacgcttctt<br>tgttggcttatggtatgcctaaggaagcttgtgattggtatgctcactccttgaattataatactccaggtggtaaatt<br>gaaccgtggtttgtctgttgttgacacttacgctatttttatctaacaagaccgtcgagcaattgggtcaagaagagta<br>tgaaaaggtcgctattttaggttggtgtattgaattgttgcaagctactggttggttgccgatgacatgatggacaa<br>gtctattactcgtcgtcgtgccaacctttgctggtataaggtcccagaggttgatgaattgctatctgggacgtttcat<br>gttggaagctgctatctataaattgttgaaatcccacttcagaaacgagaaatactacattgacatcaccgagttgtt<br>ccacgaagtcactttccaaactgagttaggtcaattaatggacttgatcaccgctccagaagacaaagttgacttgt<br>ccaagttttccttgaaaaagcactcttttcatcgttacttttcaagactgcttattactctttctacttaccagttgccttg<br>gctatgtacgtcgccggtatcactgacgaaaaggacttgaagcaagctcgtgacgttttgattccattaggtgaatttt<br>ccaaatccaagatgactacttagactgttttggtaccccctgaacaaatcggtaagatcggtactgatattcaagata<br>acaagtgctcttgggttatcaacaaggctttagagttagcctccgccgaacaacgtaaaactttagatgaaaacta<br>cggtaaaaagactcgtgttgctgaggccaagtgtaagaagattttaacgatttaaaaatcgaacaattgtatcacg<br>aatatgaagagtccattgctaaggatttgaaggctaaaattctcaagttgacgaatcccgtggtttcaaagctgac<br>gttttgactgcttttttaaacaaggtttacaagcgttccaaataa |
| SEQ ID NO: 162<br>Artificial tetraketide<br>synthase (TKS)<br>nucleotide sequence | atgaaccatttaagagctgagggtccagcttccgtcttggctatcggtactgctaatccagagaacattttattacaa<br>gatgagttccagattactatttccgtgttactaagtccgagcatatgacccaattgaaagaaaagttccgtaaaatc<br>tgtgataaatctatgattagaaaaagaaactgcttttttaaacgaagaacacttgaagcaaaacccaagattagttga<br>acacgagatgcaaaccttggacgctagacaagatatgttggttgtcgaggttcctaaattgggtaaagacgcctg<br>tgctaaagctatcaaagagtcgggtcaacctaagtccaagatcacttccttaatcttcacttccgcttccaccactg<br>acatgcctggtgctgattaccactgtgccaagttgttgggtttgtctccttctgtcaagagagttatgatgtaccaatt |

US 10,563,211 B2

301
302

TABLE 1-continued

Amino acid and nucleotide sequences of the disclosure

| SEQ ID | SEQUENCE |
|---|---|
| | aggttgttacggtggtggtactgtcttaagaattgctaaggacatcgctgaaaacaacaaaggtgctagagtttta gccgtttgttgtgacatcatggccttgtttatttcgtggtccatctgaatctgacttggagttgttggttggtcaagctatt tttggtgatggtgccgctgccgtcatcgttggtgctgagccagatgaatccgttggtgaaagaccaattttcgaatt agtctctactggtcaaactattttgccaaactccgagggtactatcggtggtcatattcgtgaagccggtttaatctttt gatttgcacaaagacgttccaatgttgatctctaacaacatcgaaaagtgttttaattgaggcttttactccaattggta tctctgactggaactctatcttctggatcactcatccaggtggtaaggctatcttggacaaggttgaagaaaaatta catttaaagtccgataaattcgtcgattctcgtcatgtttgtctgaacacggtaacatgtcttcctccactgtcttgttt gttatggatgaattacgtaagagatctttggaggagggtaagtctactactggtgatggtttcgaatgggtgttttg ttcggtttcggtcctggtttgactgttgaacgtgttgttgttagatctgttccaattaagtactag |
| SEQ ID NO: 163 Artificial olivetolic acid cyclase (OAC) nucleotide sequence | atggccgtcaaacacttgatcgtcttaaaattcaaggatgaaattactgaagctcaaaaagaagagttcttcaaaa cctatgtcaatttagtcaacattattcctgctatgaaggacgtttactggggtaaggatgtcacccaaaagaacaag gaagaaggttacactcacattgttgaagtcacttttcgaatctgttgaaactatccaagattatattatccacccagct catgtcggttttggtgatgtttacagatcttttttgggaaaaattgttgatctttgactatactccaagaaaataa |
| SEQ ID NO: 164 Artificial acyl-activating enzyme Cs_AAE1_v1 nucleotide sequence | atgggtaagaattacaagtccttagactctgttgttgcttctgactttattgctttaggtattacttccgaagttgctgaa acccttacacggtagattggctgaaattgctcgaactacggtgctgctacccctccaaacttggattaacattgctaatca tattttgtctccagatttgccatttttcttacaccaaatgttgttctacggttgttacaaggatttcggtcctgctcctc cagctctggattcctgatccagaaaaagtcaaatctactaactttgggtgctttgttggaaaagaggtaaggagttt ttgggtgttaagtacaaggacccaatttcttctttctctcacttccaagaattctctgttagaaaccctgaagtttactg gagaactgttttgatggatgaatgaagatttcttttttctaaggacccagagtgtatcttaagaagaagacgacatta caatccaggtggttctgagtggttaccaggtggttacttgaactctgccaaaaattgcttgaacgttaactctaaca agaaattgaatgacactatgattgtctgagagatgagggtaacgatgatttgcctttgaataaattgactttggatc aattgagaaaaagagtctggttggttggttacgcttggaagaaatgggtttagaaaaggttgtgctatcgccatc gatatgcctatgcacgttgatgctgttgttatttattggctattgtttttagctggttatgtgttgtttccatcgccga ctccttctctgctccagaaatctccaccagattgagattgctaaagcaaagccattttcacccaagaccacatcatta gaggtaagaagcgtattccattgtattccgtgttgttgaagctaaatctcctatggctatcgtcatcccatgctctgg ttctaacatcggtgctgaattaagagacggtgatatttcttgggactactttttagaaagagctaaagaattcaaaaa ctgcgagtttactgctagagaacaacctgtcgacgcttatactaatattttattctcttctggtactactggtgaaccta aggctattccatggacccaagctactccttgaaagcccgctgctgatgttggtcccatttagacatcagaaaagg tgatgtcatcgtctggccaactaacttaggttggatgatgggtccatggttagtctacgcttctttgttgaatggtgcc tctatcgccttatataatggttccccttagtctctggttttgctaaattcgttcaagatgctaaggttaccatgttaggt gttgtcccttctatcgttagatcttggaaatctactaactgtgtttctggttacgactggtccactattcgttgtttctct tcttctggtgaagcttccaagtcgatgagtaactaggttaatgggtcgtgctaactacaagccagtcatcgaaatgt gcggtggtactgaaattggtggtgcttttccgctggttctttttttacaagcccaatccttgtcttccttctcctctcaat gtatgggttgtactttatatatcttagataagaatggttaccctatgcctaaaaacaagccaggtattggtgaattagc tttgggtcctgttatgtttggtgcttctaaaaccttgttaaatggtaatcatcacgacgttacttcaaaggtatgcctac tttgaacggtgaggttttgagacgtcatggtgatattttcgaattaacttccaacggttattatcacgctcacggtaga gctgatgatactatgaacattggtggtattaagatctcttccatcgaaattgagagagtttgtaacgaggttgacgat cgtgttttcgaaactactgctattggtgtccctccttaggtggtggtccagaacaattggttatcttttcgtcttgaag gactccaacgacaccactatcgacttaaaccaattaagattgtcttcaacttgggttttgcaaaagaagttgaatcc attatttaaggttactcgtgtcgttccattgtcctccttgccaagaactgctaccaacaagattatgcgtagagtcttg agacaacaattctctcactttgagtaa |
| SEQ ID NO: 165 Artificial acyl-activating enzyme Cs_AAE1_v2 nucleotide sequence | atgggtaagaactacaaatccttagattccgtcgtcgcttctgatttcatcgctttgggtattacttctgaagttgctga aacccttgcatggtagattggctgaaattgctcgtacggtgctgctaccccacaaacttggatcaacattgcta accacatcttatccccctgacttgccattctccttacaccaaatgttgtctacggttgttataaagatttcggtccagct cctcctgcttggattcctgacccagagaaggttaagtctactaatttaggtgctttgttagaagagaggtaaggaat ttttaggtgttaagtataaagatccaatttcttccttctctcacttccaagaatttctgttagaaaccagaagtttac tggagaactgttttgatggtgaaatgaagatctcttttttccaaggaccagagtgtattttgagacgtgatgacatc aacaatccaggtggttctgagtggttaccaggtggttacttgaactctgccaagaatttgttgaacgttaactctaac aaaaagttgaacgataccatgattgttttggagagacgaaggtaacgatgatttgccattgaataagttaaccttgg atcaattgagaaaaagagtctggttagtcggttacgcttggaagagatgggtttggaaaagggtgtgctatcgccat cgatatgccaatgcatgttgatgctgttgttatctatttggccattgttttggctggttacgttgttgtttccatcgct gactccttctctgctccagaaatttctactagattaagattgctaaagcaaagccattttcactcaagaccatcat tagaggtaagaaaagaattccattgtattccagagttgttgaagctaaatccccaatggccatcgtcatcccatgct ctggttctaatattggtgccgaattgagagacggtgatatctcttgggactacttttttggagcgtgctaaagaattta aaaactgcgaattcaccgccagagaacaaccagttgacgcctacactaacattttgttttcttctggtactactggt gaacctaagctattccatggactcaagctactccattgaaagccgccgccgatggttggtcccacttagatatta gaaaggtgatgtcatcgtctggcctactaacttgggttggatgatgggtccttggttagttacgcttccttattgaac ggtgcctctatcgctttatataatggttccccttagtttctggttttgctaaattcgttcaagatgctaaggttactat gttgggtgtcgtcccatccattgtccgttcctggaagtctaccaattgtgtttctggttatgattggtctactattcgttg ttttctcttcctctggtgaagcttctaatgtcgatgaatattttggtggttaatgggtagagctaactacaagccagttattg aaatgtgtggtggtactgaaattggtggtgcttttctctgctggttccttttgcaagctcaatccttgtcttctttctcc tcccaatgtatgggttgcactttatacatcttggacaagaatggttaccctatgccaaagaataaaccaggtattggtg aattggctttgggtccagtcatgttcggtgcttctaagacttttgttgaacggtaaccatcatgacgtctacttcaagg gtatgcctacctttgaacggtgaagttttaagacgtcacggtgacgatattttcgaattgacttccaacggttattatcatgc tcacggtagagctgacgacactatgaacatcggtggtattaagatctcttctatcgaaattgaaagagtttgcaacg aggttgatgatcgtgtcttcgaaaccactgctattggtgtccctcctttaggtggtggtcctgagcaattggttattttc tttgtcttaaaggattctaacgacaccactattgacttaaatcaattgagattgtccttcaatttgggtttgcaaagaa gttgaacccattattcaaggttactcgtgtcgttccttttgtcctcctttgccaagaaccgctaccaataaaattatgaga cgtgttttcgctcaacaattctctcactttgaataa |
| SEQ ID NO: 166 Artificial acyl-activating enzyme | atgaaaaatctggttatggtagagacggtatctacagatccttgcgtcctccattacacttgccaaacaataataa cttatctatggttcctttttgttccgtaactcttcctcttacccacaaaaaccgtgctttgattgactccgaaaccaatca aatcttgtccttttcccacttcaaatctactgtcattaaagtctctcacggtttcttgaactaggtattaagaagaacg |

TABLE 1-continued

Amino acid and nucleotide sequences of the disclosure

| SEQ ID | SEQUENCE |
|---|---|
| Cs_AAE3 nucleotide sequence | actggttgatctacgctcctaattccatccactttccagtttgtttcttgggtatcattgcttctggtgccattgctacca cttctaacccttatacactgtttctgagttatctaagcaagttaaagattctaacccaaaattgattatcactgtccca caattattagaaaaggtcaagggtttcaatttaccaaccattttaatcggtccagactccgaacaagagtcttcttcc gataaagttatgacttttaacgacttagttaacttgggtggttcttctggttctgagttcccaatcgtcgatgatttcaa gcaatctgacaccgccgctttattgtattcctctgactactggtatgtctaagggttggttgactcacaaaaacttt atcgcttcctctcttgatggttaccatggaacaagacttggttggtgaaatggataacgtcttcttgtgttttttaccaat gttccatgttttcggtttagctatcattacttacgctcaattacaaagaggtaacactgtcatctctgctcgttttgactt agaaaagatgttgaaagacgttgaaaagtacgttactcacttgtggtggcctcctgttattttagctttgtctaagaat tctatggttaaattcaacttgtcctctatcaagtacattggttctggtgccgctccattaggtaaggacttgatggaag aatgttctaaatggccttacggtatcgtcgctcaaggttacggtatgactgaaacttgtggtatcgtttctatggaag acatcagaggtggtaagcgtaactccggttctgctggtatgttggcttccggtgttgaagcccaaattgtttctgtc gatactttgaaacctttgccacctaaccaattaggtgaaatttgggttaaaggtcctaacatgatgcaaggttacttc aataaccctcaagctactaagttaacttattgataagaaagggttgggttcatactggtgatttgggttacttcgatgaa gatggtcatttgtactgggatagaatcaaagaattaattaagtataaaggtttccaagttgccccagctgaattgga aggtttgttggttctcatcctgaaattttagatgcttggattcctttcccagacgctgaagccggtgaagttccagtt gcttactggagatcccctaactcttccttgactgaaaacgacgtcaagaagttcatcgctggtcaagttgcttcctttt aagagattaagaaagtcaccttcatcaactccgttccaaagtctgcttccggtaagattttgagaagagaattaat ccaaaaggttcgttccaacatgtag |
| SEQ ID NO: 167 Artificial cannabidiolic acid synthase (CBDAS) nucleotide sequence | atgaaatgttccacctttctttctggtttgtttgtaagatcatcttcttcttcttcctcttcaacatccaaacttccat cgctaatccaagagagaatttcttaaagtgttttctcaatacatcccaaacaatgctactaacttaaagttggtttaca ctcaaaataacccattgtacatgtctcgtcttgaactctaccattcacaattttgcgttttacttctgacaccaccctaag ccattagttattgttaccccatcccacgtctctcacatccaaggtactattttgtgttctaaaaaggttggtttgcaaat tagaactagatctggtggtcacgactccgagggtatgtcttacatctctcaagttccattcgttattgtcgacttgcgta acatgcgttccatccaaaatcgatgttcactcccaaactgcttgggtcgaagccggtgccacttaggtgaggtttattac tgggtcaatgagaagaatgagaatttgtccttggctgctggttattgtccaaccgtctgtgctggtggtcatttttggtg gtggtggtacggtccattaatgagaaactatggtttggctgccgataacattatcgacgctcacttggttaatgtcc acggtaaggtcttagtagaaaatccatgggtgaggacttgttctgggctttgagaggtggtggtgctgagtccttt ggtatcatcgttgcttggaaaattcgtttagttgctgtcccaaaatctactatgttttctgttaagaagatcatggaaatt cacggttggttaagttggttaataagtggcaaaatattgcctacaagtatgacaaagacttgttattgatgactcac ttcatcactagaaacatcaccgataaccaaggtaaaaataaaactgctatccataccttctcctccgttttcttgg gtggtgtcgactccttagttgatttgatgaacaaatcttttcctgaattaggtatcaagaagactgattgtcgtcaattg tcctggattgataccattatctttactctggtgtcgtcaattacgacaccgataatttcaataaggaaatttattggac agatctgccggtcaaaacggtgcttcaagatcaagttggactaacgttaaaaaaccaatcccagaatccgtctttgt ccaaattttggagaagttatacgaggaagacatcggtgctggtatgtatgccttatatccatacgttgtattatgg atgaaatttccgaatctgctatcccatttccacatcgtgctggtattttgtatgaatatggtacatttgttcctgggaaa agcaagaagataacgagaagcacttgaattggatcagaaatatctacaatttcatgactccttacgtttctaagaat cctcgtttggcttacttgaactacagagatttggacatcggtattaatgacccaaagaacccaaataactactactca agctagaatttgggtgaaaagtacttcggtaaaaacttgacagattgtcagattgtttaaggttaagactttagttgatccaaa taacttcttcagaaatgaacaatccatcccaccattgcctagacacagagcactaa |
| SEQ ID NO: 168 Medium chain fatty acyl-CoA synthelase Sc_FAA2 nucleotide sequence Saccharomyces sp. | atggccgctccagattatgcacttaccgatttaattgaatcggatcctcgtttcgaaagtttgaagacaagattagcc ggttacaccaaaggctctgatgaatatattgaagagctatactctcaattaccactgaccagctaccccaggtaca aaacatttttaaagaaacaggcggttgccatttcgaatccggataatgaagctggttttagctcgatttataggagtt ctctttcttctgaaatctagtgagctgtgtggataaaaacttaagaactgcatacgatcacttcatgttttctgcaag gagatgcctcaactgactgtttaggttcaaggccaattgataaagccacaggcacctgggagggaaacattcc gtttcgagtcgtactccacggtatctaaaagatgtcataatatcggaagtggtatattgtcttttggtaaacacgaaaa ggaaacgtcctttggaagccaatgattttgttgttgctatcttatcacacaacaaccctgaatggatcctaacagattt ggcctgtcaggcctattctctaactaacacggctttgtacgaaacattaggtccaaacacctccgagtacatattga atttaaccgaggccccccattctgattttttgcaaaatcaaatatgtatcatgtattgaagatggtgcctgatatgaaattt gttaatacttttggtttgtatggatgaatttaactcatgacgagctccgtatgctaaatgaatcgttgctaccgttaagt gcaactctctcaatgaaaaaatcacatttttttcattggagcaggtagaacaagttggttgctttaacaaaattcctgc aattccacctaccccagattccttgtatactatttcgtttacttctggtactacaggttttacctaaaggtgtggaaatgt ctcacagaaacattgcgtctgggatagcatttgcttttttctaccttcagaataccgccagataaaagaaaccaacagt tatatgatatgtgtttttttgccattggctcatattttctgaaaagatggttattgcgtatgatcctagccatcgggtttgga ataggcttcttacataaaccagacccaactgtattggtagaggatttgaagattttgaaacctttacgcggttgccct ggttcctagaatattaacacggtttgaagccggtataaaaatgctttggataaaatcgactgtccagaggaacgta gcaaatactatattggattctaaatcggccagatttaccgcaagaggtggtccagataaatcgattatgaatttttcta gtttatcatcgcgtattgattgataaaatcagagactcttttaggtttgtccaataactcgtttataattaccggatcagc tcccatatctaaagataccttactattttttaagaagcgccttggatattggtataagacagggctacggcttaactga aactttgctggtgtctgtttaagcgaaccgtttgaaaagatgtcggatcttgtggtgccataggtatttctgcaga atgtagattgaagtctgttccagaaatgggttaccatgccgacaaggattttaaaaggtgaactgcaaattcgtggc ccacaggttttgaaagatattttaaaaaatccgaatgaaactttcaaaagccgttgaccaagatggttggttttccacg ggagatgttgcatttatcgatgcaaaaggtcgcatcagcgtcattgatcgagtcaagaacttttttcaagctagcaca tggtgaatatattgctccagagaaaatcgaaaatatttatttatcatcatgcccctatatcacgcaaatatttgtctttg gagatcctttgaagacatttttagttggcatcgttggtgttgatgttgatgcagcgcaaccgattttagctgcaaagc acccagaggtgaaactggactaaggaagtgctagtagaaaactaaatcgtaataaaaagctaaggaagga attttttaaacaaaattaataaatgcatcgatgggctacaaggatttgaaaaattgcacaacatcaaagtcggacttg agcctttgactctcgaggatgatgttgtgacgccaacttttaaaataaagcgtgccaaagcatcaaaattcttcaaa gatacattagaccaactatacgccgaaggttcactagtcaagacagaaaagctttag |
| SEQ ID NO: 169 Medium chain fatty acyl-CoA synthetase Sc_FAA2 Saccharomyces sp. | MAAPDYALTDLIESDPRFESLKTRLAGYTKGSDEYIEELYSQLPLTSYP<br>RYKTFLKKQAVAISNPDNEAGFSSIYRSSLSSENLVSCVDKNLRTAYDH<br>FMFSARRWPQRDCLGSRPIDKATGTWEETFRFESYSTVSKRCHNIGSGI<br>LSLVNTKRKRPLEANDFVVAILSHNNPEWILTDLACQAYSLTNTALYE<br>TLGPNTSEYILNLTEAPILIFAKSNMYHVLKMVPDMKFVNTLVCMDEL |

TABLE 1-continued

Amino acid and nucleotide sequences of the disclosure

| SEQ ID | SEQUENCE |
|---|---|
| | THDELRMLNESLLPVKCNSLNEKITFFSLEQVEQVGCFNKIPAIPPTPDS<br>LYTISFTSGTTGLPKGVEMSHRNIASGIAFAFSTFRIPPDKRNQQLYDMC<br>FLPLAHIFERMVIAYDLAIGFGIGFLHKPDPTVLVEDLKILKPYAVALVP<br>RILTRFEAGIKNALDKSTVQRNVANTILDSKSARFTARGGPDKSIMNFL<br>VYHRVLIDKIRDSLGLSNNSFIITGSAPISKDTLLFLRSALDIGIRQGYGL<br>TETFAGVCLSEPFEKDVGSCGAIGISAECRLKSVPEMGYHADKDLKGE<br>LQIRGPQVFERYFKNPNETSKAVDQDGWFSTGDVAFIDAKGRISVIDR<br>VKNFFKLAHGEYIAPEKIENIYLSSCPYITQIFVFGDPLKTFLVGIVGVD<br>VDAAQPILAAKHPEVKTWTKEVLVENLNRNKKLRKEFLNKINKCIDGL<br>QGFEKLHNIKVGLEPLTLEDDVVTPTFKIKRAKASKFFKDTLDQLYAE<br>GSLVKTEKL* |
| SEQ ID NO: 170<br>MBPtag | atgaaaatcgaagagggtaaattggtcatctggatcaatggtgacaaaggttacaacggtttggctgaagtcggt<br>aaaaaaattcgagaaagacactggtattaaggttaccgtcgaacacccagataagttggaagaaaaatttccacaa<br>gttgccgctactggtgatggtccagacatcattttctgggcccacgacagatttggtggttatgctcaatctggtttg<br>ttagccgagatcaccccagacaaagcctttcaagataaattatacccatttacctgggatgctgtccgttacaacg<br>gtaagttgatcgcttaccaatcgccgttgaagctttgtctttaatctacaataaagacttattgccaaaccctccaaa<br>gacctgggaagaaattcctgccttggataaggaattaaaggtcaaaggtaaatctgccttaatgttcaacttacaa<br>gagcctacttttacttggccattgattgctgctgatggtggttatgctttttaagtacgaaaatggtaaatacgacatta<br>aagatgttggtgttgacaatgccggtgctaaagccggtttaactttcttagtcgacttgatcaagaacaagcacatg<br>aatgctgacactgttattctatcgctgaagccgccttcaacaaggtgaaactgctatgactatcaatggtccttg<br>ggcctggtctaatattgacacctccaaagtcaactacggtgttactgtcttaccaacttttcaaaggtcaaccttccaa<br>gccatttgtcggtgttgtctgctggtattaacgctgcctctccaaacaaagaattggccaaggaatttggaaaa<br>ctacttgttgactgacgaaggtttagaggctgttaacaaagacaaaccattgggtgctgtcgccttgaaatcctac<br>gaagaagaattagccaaggatccaagaatcgccgctaccatggaaaatgctcaaaaaggtgaaattatgccaa<br>acattccacaaatgtccgcttttttggtacgcgttagaactgctgttattaatgctgcttctggtagacaaactgtcga<br>tgaagctttgaaggacgctcaaaccagaatcactaag |
| SEQ ID NO: 171<br>GS12 Linker | ggaggtggaggaggtggttccggaggaggtggttct |
| SEQ ID NO: 172<br>GS12 Linker | GGGGGGSGGGGS |
| SEQ ID NO: 173<br>GB1 tag | atgtctgacacttacaagttgatcttgaacggtaagactttgaaaggtgaaactactaccgaagctgttgatgctgc<br>cactgctgaaaaggttttttaagcaatacgccaatgataacggtgtcgacggtgaatggacttacgatgatgccact<br>aagactttaccgttactgaa |
| SEQ ID NO: 174<br>GB1 tag | MSDTYKLILNGKTLKGETTTEAVDAATAEKVFKQYANDNGVDGEWT<br>YDDATKTFTVTE |
| SEQ ID NO: 175<br>MFalpha1_1-19 | atgagatttccttcaattttttactgcagttttattcgcagcatcctccgcattagct |
| SEQ ID NO: 176<br>MFalpha1_1-19 | MRFPSIFTAVLFAASSALA |
| SEQ ID NO: 177<br>MFalpha1_1-89 | atgagatttccttcaattttttactgcagttttattcgcagcatcctccgcattagctgctccagtcaacactacaacag<br>aagatgaaacggcacaaattccggctgaagctgtcatcggttacttagatttagaagggggattcgatgttgctgtt<br>ttgccattttccaacagcacaaataacgggttattgtttataaatactactattgccagcattgctgctaaagaagaa<br>ggggtatctttggataaaagagaggctgaagct |
| SEQ ID NO: 178<br>MFalpha1_1-89 | MRFPSIFTAVLFAASSALAAPVNTTTEDETAQIPAEAVIGYLDLEGDFD<br>VAVLPFSNSTNNGLLFINTTIASIAAKEEGVSLDKREAEA |
| SEQ ID NO: 179<br>DasherGFP | atgaccgcactaacagaaggagctaaactattcgaaaaggagattccttacattacagaattagagggtgatgtc<br>gaaggaatgaaattcattatcaagggcgagggtactggtgacgctactaccggtacgattaaagcaaagtacat<br>ctgtacaacaggtgaccttcctgttcgtgggctactctggtgagcacttttgtcttatggagttcaatgttttgctaaa<br>taccttcgcacattaaaagactttttccaaaagtgcaatgcctgagggctatactcaggagagaacaatatcttcga<br>aggagatggtgtgtataagactaggctatggtcacgtatgaaagaggatccatctacaatagagtaactttaact<br>ggtgaaaacttcaaaaggacggtcacatccttagaaagaatgttgcctttcaatgcccaccatccatcttgtacat<br>tttgccagacacagttaacaatggtatcagagttgagttaaccaagcttatgacatagagggtgtcaccgaaaag<br>ttggttacaaaatgttcacagatgaatcgtcccctggcaggatcagctgccgtccatatcccacgttaccatcatat<br>cacttatcataccaagctgtccaaagatcgtgatgagagaagggatcacatgtgtttggttgaagtggtaaaggc<br>cgtggatttggatacttaccaaggttga |
| SEQ ID NO: 180<br>DasherGFP | MTALTEGAKLFEKEIPYITELEGDVEGMKFIIKGEGTGDATTGTIKAKYI<br>CTTGDLPVPWATLVSTLSYGVQCFAKYPSHIKDFFKSAMPEGYTQERT<br>ISFEGDGVYKTRAMVTYERGSIYNRVTLTGENFKKDGHILRKNVAEQC<br>PPSILYILPDTVNNGIRVEFNQAYDIEGVTEKLVTKCSQMNRPLAGSAA<br>VHIPRYHHITYHTKLSKDRDERRDHMCLVEVVKAVDLDTYQG* |
| SEQ ID NO: 181<br>ER1 tag | atattagagcaacctctgaaatttgtgctactgcggccgtcgtgctcttgacgacgtcggttcttgttgtgtagtatt<br>tacataa |

TABLE 1-continued

Amino acid and nucleotide sequences of the disclosure

| SEQ ID | SEQUENCE |
| --- | --- |
| SEQ ID NO: 182<br>ER1 tag | ILEQPLKFVLTAAVVLLTTSVLCCVVFT* |
| SEQ ID NO: 183<br>ER2 tag | tctacctctgaaaaccaaagtaaaggtagtggtacattggttgtcatattggccattttaatgctaggtgttgcttatta<br>tttgttgaacgaataa |
| SEQ ID NO: 184<br>ER2 tag | STSENQSKGSGTLVVILAILMLGVAYYLLNE* |
| SEQ ID NO: 185<br>PM1 tag | tggtacaaggatctaaaaatgaagatgtgtctggctttagtaatcatcatattgcttgttgtaatcatcgtccccattg<br>ctgttcactttagtcgataa |
| SEQ ID NO: 186<br>PM1 tag | WYKDLKMKMCLALVIIILLVVIIVPIAVHFSR* |
| SEQ ID NO: 187<br>VC1 tag | aatataaaagaaataatgtggtggcagaaggtcaaaaatattacgttattaactttcactattatactatttgtaagtg<br>ctgctttcatgttttttctatctgtggtaa |
| SEQ ID NO: 188<br>VC1 tag | NIKEIMWWQKVKNITLLTFTIILFVSAAFMFFYLW* |
| SEQ ID NO: 189<br>PEX8 tag | tctaaattataa |
| SEQ ID NO: 190<br>PEX8 tag | SKL* |
| SEQ ID NO: 191<br>Long chain fatty<br>acyl-CoA synthetase<br>Sc_FAA1<br>Saccharomyces<br>cerevisiae | atggttgctcaatataccgttccagttgggaaagccgccaatgagcatgaaactgctccaagaagaaattatcaat<br>gccgcgagaagccgctcgtcagaccgcctaacacaaagtgttccactgtttatgagtttgttctagagtgctttca<br>gaagaacaaaaattcaaatgctatgggttggagggatgttaaggaaattcatgaagaatccaaatcggttatgaa<br>aaaagttgatggcaaggagacttcagtgaaaagaaatggatgtattatgaactatcgcattatcattataattcatt<br>tgaccaattgaccgatatcatgcatgaaattggtcgtgggttggtgaaaataggattaaagcctaatgatgatgac<br>aaattacatcttttacgcagccacttctcacaagtggatgaagatgttcttaggagcgcagtctcaaggtattcctgtc<br>gtcactgcctacgatactttgggagagaaagggctaattcattctttggtgcaaacggggtctaaggccatttttac<br>cgataactcttttattaccatccttgatcaaaccagtgcaagccgctcaagacgtaaaatacataattcatttcgattc<br>catcagttctgaggacaggaggcaaagtggtaagatctatcaatctgctcatgatgccatcaacagaattaaaga<br>agttagacctgatatcaagacctttagctttgacgacatcttgaagcttggtaaggaaatcctgtaacgaaatcgatg<br>ttcatccacctggcaaggatgatctttgttgcatcatgtatacgtctggttctacaggtgagccaaaggggtgttgtctt<br>gaaacattcaaatgttgtcgcaggtgttggtggtgcaagtttgaatgttttgaagtttgtgggcaataccgaccgtgt<br>tatctgttttttgccactagctcatatttttgaattggttttcgaactattgtccttttattggggggcctgcattggtt<br>atgccaccgtaaaaacttaactagcagctctgtgagaaattgtcaaggtgatttgcaagaattcaagcccacaatcat<br>ggttggtgtcgccgctgtttgggaaacagtgagaaaagggatcttaaaccaaattgataatttgcccttcctcacc<br>aagaaaatcttctggaccgcgtataataccaagttgaacatgcaacgtctccacatccctggtggcggcgcctta<br>ggaaacttggttttcaaaaaaatcagaactgccacaggtggccaattaagatatttgttaaacggtggttctccaat<br>cagtcgggatgctcaggaattcatcacaaatttaatctgccctatgcttattggttacggtttaaccgagacatgcg<br>ctagtaccaccatcttggatcctgctaattttgaactcggcgtcgctggtgacctaacaggttgtgttaccgtcaaa<br>ctagttgatgttgaagaattaggttattttgctaaaaacaaccaaggtgaagtttggatcacaggtgccaatgtcac<br>gcctgaatattataagaatgaggaagaaacttctcaagctttaacaagcgatggttggttcaagaccggtgacatc<br>ggtgaatgggaagcaaatggccatttgaaaattaattgacaggaagaaaaacttggtcaaaacaatgaacggtga<br>atatatcgcactcgagaaattagagtccgtttacagatctaacgaatatgttgctaacatttgtgtttatgccgaccaa<br>tctaagactaagccagttggtattattgtaccaaatcatgctccattaacgaagcttgctaaaaagttgggaattatg<br>gaacaaaaagacagttcaattaatatcgaaaattatttggaggatgcaaaattgattaaagctgtttattctgatcttt<br>gaagacaggtaaagaccaaggtttggttggcattgaattactagcaggcatagtgttctttgacggcgaatggact<br>ccacaaaacggttttgttacgtccgctcagaaattgaaaagaaaagacatttttgaatgctgtcaaagatagtaaagttga<br>cgccgtttatagttcgtcttaa |
| SEQ ID NO: 192<br>Long chain fatty<br>acyl-CoA synthetase<br>Sc_FAA1<br>Saccharomyces<br>cerevisiae | MVAQYTVPVGKAANEHETAPRRNYQCREKPLVRPPNTKCSTVYEFVL<br>ECFQKNKNSNAMGWRDVKEIHEESKSVMKKVDGKETSVEKKWMYY<br>ELSHYHYNSFDQLTDIMHEIGRGLVKIGLKPNDDDKLHLYAATSHKW<br>MKMFLGAQSQGIPVVTAYDTLGEKGLIHSLVQTGSKAIFTDNSLLPSLI<br>KPVQAAQDVKYIIHFDSISSEDRRQSGKIYQSAHDAINRIKEVRPDIKTF<br>SFDDILKLGKESCNEIDVHPPGKDDLCCIMYTSGSTGEPKGVVLKHSNV<br>VAGVGGASLNVLKFVGNTDRVICFLPLAHIFELVFELLSFYWGACIGY<br>ATVKTLTSSSVRNCQGDLQEFKPTIMVGVAAVWETVRKGILNQIDNLP<br>FLTKKIFWTAYNTKLNMQRLHIPGGGALGNLVFKKIRTATGGQLRYLL<br>NGGSPISRDAQEFITNLICPMLIGYGLTETCASTTILDPANFELGVAGDL<br>TGCVTVKLVDVEELGYFAKNNQGEVWITGANVTPEYYKNEEETSQAL<br>TSDGWFKTGDIGEWEANGHLKIIDRKKNLVKTMNGEYIALEKLESVY<br>RSNEYVANICVYADQSKTKPVGIIVPNHAPLTKLAKKLGIMEQKDSSIN<br>IENYLEDAKLIKAVYSDLLKTGKDQGLVGIELLAGIVFFDGEWTPQNG<br>FVTSAQKLKRKDILNAVKDKVDAVYSSS* |
| SEQ ID NO: 193<br>Truncated medium<br>chain fatty acyl-CoA | atggccgctccagattatgcacttaccgatttaattgaatcggatcctcgtttcgaaagtttgaagacaagattagcc<br>ggttacaccaaaggctctgatgaatatattgaagagctatactctcaattaccactgaccagctaccccaggtaca<br>aaacattttttaaagaaacaggcggttgccatttcgaatccggataatgaagctggttttagctcgatttataggagtt |

TABLE 1-continued

Amino acid and nucleotide sequences of the disclosure

| SEQ ID | SEQUENCE |
|---|---|
| synthetase<br>Sc_FAA2_Ctrunc | ctctttcttctgaaaatctagtgagctgtgtggataaaaacttaagaactgcatacgatcacttcatgttttctgcaag<br>gagatggcctcaacgtgactgtttaggttcaaggccaattgataaagccacaggcacctgggaggaaacattcc<br>gtttcgagtcgtactccacggtatctaaaagatgtcataatatcggaagtggtatattgtctttggtaaacacgaaaa<br>ggaaacgtcctttggaagccaatgattttgttgttgctatcttatcacacaacaaccctgaatggatcctaacagattt<br>ggcctgtcaggcctattctctaactaacacggctttgtacgaaacattaggtccaaacacctccgagtacatattga<br>atttaaccgaggcccccattctgattttgcaaaatcaaatatgtatcatgtattgaagatggtgcctgatatgaaattt<br>gttaatactttggtttgtatggatgaattaactcatgacgagctccgtatgctaaatgaatcgttgctacccgttaagt<br>gcaactctctcaatgaaaaaatcacattttttcattggagcaggtagaacaagttggttgctttaacaaaattcctgc<br>aattccacctaccccagattccttgtatactatttcgttttacttctggtactacaggttttacctaaaggtgtggaaatgt<br>ctcacagaaacattgcgtctgggatagcatttgctttttctaccttcagaataccgccagataaaagaaaccaaca<br>gttatatgatatgtgttttttgccattggctcatattttgaaagaatggttattgcgtatgatctagccatcgggtttg<br>gaataggcttcttacataaaccagacccaactgtattggtagaggatttgaagattttgaaaccttacgcggttgccct<br>ggttcctagaatattaacacggtttgaagccggtataaaaaatgcttggataaatcgactgtccagaggaacgta<br>gcaaatactatattggattctaaatcggccagatttaccgcaagaggtggtccagataaatcgattatgaattttcta<br>gtttatcatcgcgtattgattgataaaatcagagactctttaggtttgtccaataactcgtttataattaccggatcagc<br>tcccatatctaaagatacccttactattttttaagaagcgccttggatattggtataagacagggctacggcttaactga<br>aactttttgctggtgtctgtttaagcgaaccgtttgaaaaagatgtcggatcttgtggtgccataggtatttctgcaga<br>atgtagattgaagtctgttccagaaatgggttaccatgccgacaaggatttaaaaggtgaactgcaaattcgtggc<br>ccacaggttttttgaaagatattttaaaaatccgaatgaaacttcaaaagccgttgaccaagatggttggttttccacg<br>ggagatgttgcatttatcgatgcaaaaggtcgcatcagcgtcattgatcgagtcaagaacttttttcaagctagcaca<br>tggtgaatatattgctccagagaaaatcgaaaatatttatttatcatcatgcccctatatcacgcaaatatttgtctttg<br>gagatcctttgaagacattttttagttggcatcgttggtgttgatgttgatgcagcgcaaccgatttttagctgcaaagc<br>acccagaggtgaaaacgtggactaaggaagtgctagtagaaaacttaaatcgtaataaaaagctaaggaagga<br>atttttaaacaaaattaataaatgcatcgatgggctacaaggatttgaaaaattgcacaacatcaaagtcggacttg<br>agccctttgactctcgaggatgatgttgtgacgccaacttttaaaataaagcgtgccaaagcatcaaaattcttcaaa<br>gatacattagaccaactatacgccgaaggttcactagtcaagacatag |
| SEQ ID NO: 194<br>Truncated medium<br>chain fatty acyl-CoA<br>synthetase<br>Sc_FAA2_Ctrunc | MAAPDYALTDLIESDPRFESLKTRLAGYTKGSDEYIEELYSQLPLTSYP<br>RYKTFLKKQAVAISNPDNEAGFSSIYRSSLSSENLVSCVDKNLRTAYDH<br>FMFSARRWPQRDCLGSRPIDKATGTWEETFRFESYSTVSKRCHNIGSGI<br>LSLVNTKRKRPLEANDFVVAILSHNNPEWILTDLACQAYSLTNTALYE<br>TLGPNTSEYILNLTEAPILIFAKSNMYHVLKMVPDMKFVNTLVCMDEL<br>THDELRMLNESLLPVKCNSLNEKITFFSLEQVEQVGCFNKIPAIPPTPDS<br>LYTISFTSGTTGLPKGVEMSHRNIASGIAFAFSTFRIPPDKRNQQLYDMC<br>FLPLAHIFERMVIAYDLAIGFGIGFLHKPDPTVLVEDLKILKPYAVALVP<br>RILTRFEAGIKNALDKSTVQRNVANTILDSKSARFTARGGPDKSIMNFL<br>VYHRVLIDKIRDSLGLSNNSFIITGSAPISKDTLLFLRSALDIGIRQGYGL<br>TETFAGVCLSEPFEKDVGSCGAIGISAECRLKSVPEMGYHADKDLKGE<br>LQIRGPOVFERYFKNPNETSKAVDQDGWFSTGDVAFIDAKGRISVIDR<br>VKNFFKLAHGEYIAPEKIENIYLSSCPYITQIFVFGDPLKTFLVGIVGVD<br>VDAAQPILAAKHPEVKTWTKEVLVENLNRNKKLRKEFLNKINKCIDGL<br>QGFEKLHNIKVGLEPLTLEDDVVTPTFKIKRAKASKFFKDTLDQLYAE<br>GSLVKT* |
| SEQ ID NO: 195<br>Mutated medium<br>chain fatty acyl-CoA<br>synthetase<br>Sc_FAA2_Cmut | atggccgctccagattatgcacttaccgatttaattgaatcggatcctcgtttcgaaagtttgaagacaagattagcc<br>ggttacaccaaaggctctgatgaatatattgaagagctatactctcaattaccactgaccagctcacccagtaca<br>aaacattttttaaagaaacaggcggttgccatttcgaatccgataatgaagctggttttagctcgatttataggagtt<br>ctctttcttctgaaaatctagtgagctgtgtggataaaaacttaagaactgcatacgatcacttcatgttttctgcaag<br>gagatggcctcaacgtgactgtttaggttcaaggccaattgataaagccacaggcacctgggaggaaacattcc<br>gtttcgagtcgtactccacggtatctaaaagatgtcataatatcggaagtggtatattgtctttggtaaacacgaaaa<br>ggaaacgtcctttggaagccaatgattttgttgttgctatcttatcacacaacaaccctgaatggatcctaacagattt<br>ggcctgtcaggcctattctctaactaacacggctttgtacgaaacattaggtccaaacacctccgagtacatattga<br>atttaaccgaggcccccattctgattttgcaaaatcaaatatgtatcatgtattgaagatggtgcctgatatgaaattt<br>gttaatactttggtttgtatggatgaattaactcatgacgagctccgtatgctaaatgaatcgttgctacccgttaagt<br>gcaactctctcaatgaaaaaatcacattttttcattggagcaggtagaacaagttggttgctttaacaaaattcctgc<br>aattccacctaccccagattccttgtatactatttcgttttacttctggtactacaggttttacctaaaggtgtggaaatgt<br>ctcacagaaacattgcgtctgggatagcatttgctttttctaccttcagaataccgccagataaaagaaaccaacagt<br>tatatgatatgtgttttttgccattggctcatattttgaaagaatggttattgcgtatgatctagccatcgggtttgga<br>ataggcttcttacataaaccagacccaactgtattggtagaggatttgaagattttgaaaccttacgcggttgccct<br>ggttcctagaatattaacacggtttgaagccggtataaaaaatgcttggataaatcgactgtccagaggaacgta<br>gcaaatactatattggattctaaatcggccagatttaccgcaagaggtggtccagataaatcgattatgaattttcta<br>gtttatcatcgcgtattgattgataaaatcagagactctttaggtttgtccaataactcgtttataattaccggatcagc<br>tcccatatctaaagatacccttactattttttaagaagcgccttggatattggtataagacagggctacggcttaactga<br>aactttttgctggtgtctgtttaagcgaaccgtttgaaaaagatgtcggatcttgtggtgccataggtatttctgcaga<br>atgtagattgaagtctgttccagaaatgggttaccatgccgacaaggatttaaaaggtgaactgcaaattcgtggc<br>ccacaggttttttgaaagatattttaaaaatccgaatgaaacttcaaaagccgttgaccaagatggttggttttccacg<br>ggagatgttgcatttatcgatgcaaaaggtcgcatcagcgtcattgatcgagtcaagaacttttttcaagctagcaca<br>tggtgaatatattgctccagagaaaatcgaaaatatttatttatcatcatgcccctatatcacgcaaatatttgtctttg<br>gagatcctttgaagacattttttagttggcatcgttggtgttgatgttgatgcagcgcaaccgatttttagctgcaaagc<br>acccagaggtgaaaacgtggactaaggaagtgctagtagaaaacttaaatcgtaataaaaagctaaggaagga<br>atttttaaacaaaattaataaatgcatcgatgggctacaaggatttgaaaaattgcacaacatcaaagtcggacttg<br>agccctttgactctcgaggatgatgttgtgacgccaacttttaaaataaagcgtgccaaagcatcaaaattcttcaaa<br>gatacattagaccaactatacgccgaaggttcactagtcaagacagaaaagcttaaatag |
| SEQ ID NO: 196<br>Mutated medium | MAAPDYALTDLIESDPRFESLKTRLAGYTKGSDEYIEELYSQLPLTSYP<br>RYKTFLKKQAVAISNPDNEAGFSSIYRSSLSSENLVSCVDKNLRTAYDH |

TABLE 1-continued

Amino acid and nucleotide sequences of the disclosure

| SEQ ID | SEQUENCE |
|---|---|
| chain fatty acyl-CoA synthetase Sc_FAA2_Cmut | FMFSARRWPQRDCLGSRPIDKATGTWEETFRFESYSTVSKRCHNIGSGI LSLVNTKRKRPLEANDFVVAILSHNNPEWILTDLACQAYSLTNTALYE TLGPNTSEYILNLTEAPILIFAKSNMYHVLKMVPDMKFVNTLVCMDEL THDELRMLNESLLPVKCNSLNEKITFFSLEQVEQVGCFNKIPAIPPTPDS LYTISFTSGTTGLPKGVEMSHRNIASGIAFAFSTFRIPPDKRNQQLYDMC FLPLAHIFERMVIAYDLAIGFGIGFLHKPDPTVLVEDLKILKPYAVALVP RILTRFEAGIKNALDKSTVQRNVANTILDSKSARFTARGGPDKSIMNFL VYHRVLIDKIRDSLGLSNNSFIITGSAPISKDTLLFLRSALDIGIRQGYGL TETFAGVCLSEPFEKDVCiSCGAIGISAECRLKSVPEMGYHADKDLKGE LQIRGPQVFERYFKNPNETSKAVDQDGWFSTGDVAFIDAKGRISVIDR VKNFFKLAHGEYIAPEKIENIYLSSCPYITQIFVFGDPLKTFLVGIVGVD VDAAQPILAAKHPEVKTWTKEVLVENLNRNKKLRKEFLNKINKCIDGL QGFEKLHNIKVGLEPLTLEDDVVTPTFKIKRAKASKFFKDTLDQLYAE GSLVKTEKLK* |
| SEQ ID NO: 197 Long-chain fatty acyl-CoA synthetase Sc_FAA3 Saccharomyces cerevisiae | atgtccgaacaacactctgtcgcagtcggtaaagctgctaatgagcacgagactgcccctaggagaaatgttag agtcaagaagcggcccttaattagaccattgaactcgtcagcatctacgctgtatgaatttgccctagagtgtttca acaaggggtggaaaacgagatggtatggcttggagagatgtcatcgagattcatgagacaaagaaaaccattgtg agaaaggtagacggcaaggatataaatctatagaaaagacatggctgtattatgaaatgtcaccatataaaatgatg acctaccaggaactgatctggggtgatgcacgatatgggccgtgggctggcaaaaataggcatcaagcccaatg gagaacacaaattccacatcttcgcatctacttcccataaatggatgaagattttccttggttgcatatcccaggta tccccgtagtaaccgcgtatgatactttgggtgagagcggtttgattcactccatggttgaaaccgagtctgctgct attttcactgataatcaattattggctaaaatgatagtgcctttgcaatctgctaaagatatcaaatttcttatccata acgaacctatcgaccccaatgacagaagacaaaacggcaaactttacaaggctgctaaggatgccattaataagat cagagaagttaggccagacataaaaaatttatagttttgagaaagttgtcaagataggtaaaaaaagtaaagatga ggtcaaacttcatccacctgagccaaaagatttggcttgtatcatgtacacctcgggctcgatcagtgcaccaaaa ggtgtgtagtattgactcattataatattgtttcgggtatcgctggtgtaggtcacaacgtctttggatggatcggctcta cagaccgtgttttgtcgttcttgccattggctcatatttttgaactggtctttgaattcgaagccttttactggaacggta ttcttgggtacggtagtgttaagactttgactaatacttcgactcgtaattgtaagggtgacctggttgagtttaagcc tactattatgatcggtgtggctgccgtttccgcctttctatttttggagaaaagatcagcgatttaactc ccgtactccaaaagattttttggtctgcctatagtatgaaagaaaagagtgtaccatgcaccgggtttttaagtcgta tggtcttcaagaaagtcagacaagccaccggtggtcatcttaagtatattatgaacggtgggtctgcgatcagtatt gatgctcagaaattctttttctatcgtcctgtgtcctatgattatcggttacggccttactgaaacagttgcgaatgcttg tgttttggagcctgatcatttcgaatatggtatagttggtgatcttgttggatcggtcactgccaaattggtggatgtta aggacctaggttattatgcaaaaaacaatcaaggtgaattgcttcttaaagggtgcgccggtctgttctgaatattat aagaatccaatagaaacggcggtctcttttcacttacgatggatggtttcgtactggtgatattgttgaatggactccc aagggacaacttaaaattattgatagaagaaagaatttggttaaaaccctaaatggtgaatatattgcattagaaaa gttagaatctgtttacaggtcaaactcctatgtgaaaaatatctgtgttttatgccgatgaaagtaggggttaaaccggt gggtattgtggtacccaacccaggaccccctatctaaatttgctgtcaaattgcgtattatgaaaaagggtgaagac atcgaaaactatatccatgacaaagcattacgaaatgctgttttcaaagagatgatcgcaacagccaaatctcaaggt ttggttggtattgaactattatgtggtattgttttctttgatgaagaatggacacctgaaaatggctttgtcacatctg ctcaaaaattaaagagaagagaaatcttagccgctgttaaatcagaagtcgaaagggtttacaaagaaaattcttag |
| SEQ ID NO: 198 Long-chain fatty acyl-CoA synthetase Sc_FAA3 Saccharomyces cerevisiae | MSEQHSVAVGKAANEHETAPRRNVRVKKRPLIRPLNSSASTLYEFALE CFNKGGKRDGMAWRDVIEIHETKKTIVRKVDGKDKSIEKTWLYYEMS PYKMMTYQELIWVMHDMGRGLAKIGIKPNGEHKFHIFASTSHKWMKI FLGCISQGIPVVTAYDTLGESGLIHSMVETESAAIFTDNQLLAKMIVPLQ SAKDIKFLIHNEPIDPNDRRQNGKLYKAAKDAINKIREVRPDIKIYSFEE VVKIGKKSKDEVKLHPPEPKDLACIMYTSGSISAPKGWLTHYNIVSGI AGVGHNVFGWIGSTDRVLSFLPLAHIFELVFEFEAFYWNGILGYGSVK TLTNTSTRNCKGDLVEFKPTIMIGVAAVWETVRKAILEKISDLTPVLQK IFWSAYSMKEKSVPCTGFLSRMVFKKVRQATGGHLKYIMNGGSAISID AQKFFSIVLCPMIIGYGLTETVANACVLEPDHFEYGIVGDLVGSVTAKL VDVKDLGYYAKNNQGELLLKGAPVCSEYYKNPIETAVSFTYDGWFRT GDIVEWTPKGQLKIIDRRKNLVKTLNGEYIALEKLESVYRSNSYVKNIC VYADESRVKPVGIVVPNPGPLSKFAVKLRIMKKGEDIENYIHDKALRN AVFKEMIATAKSQGLVGIELLCGIVFFDEEWTPENGFVTSAQKLKRREI LAAVKSEVERVYKENS* |
| SEQ ID NO: 199 Long-chain fatty acyl-CoA synthetase Sc_FAA4 Saccharomyces cerevisiae | atgaccgaacaatattccgttgcagttggcgaagccgacaatgagcatgaaaccgctccaagaagaaatatcag ggttaaagacaagcctttgattagacccataaactcctcagcatctacactgtacgaattcgcctggaatgttttac caaaggtggtaagagagacggtatggcatggagagatattatagatatacatgagacgaaaaaaaccatagtca agagggtggatgttaaggataagccatcgaaaaaaacatggttgtactacgaactgactccctacataaccatg acatacgaggagatgatctgcgtaatgcacgacattggacgtgggctgataaagattggtgttaaacctaacggt gagaacaagttccacatctttgcctctacatctcacaagtggatgaaaacttttcttggttgcatgtcacaaggtattc ctgtggtcaccgcgtacgacactttgggtgagagcggtttgattcactccatggtggaaacggattccgtcgccat tttcacggacaaccagctgtttgtccaaattagcagttcctttgaaaaaccgccaagaacgtaaaattcgtcattcaca acgaaccatccgatccaagtgacaaaagacaaaatggtaagcttttacaaggctgccaaggatgctgttgacaaa atcaaggaagttagaccggacataaaaatctacagtttcgatgaaattattgagataggtaaaaaggcaaggac gaggttgaattgcatttccccaagcctgaagatccagcttgtatcatgtacacttctggttccactggtacaccaaa gggtgttggtattgacacattacaacattgtagctggtattggtggtggtgggccataacgttatcggatggattggcc caacgaccgtatttcgcattcttgccattggctcatatttttgaattaatctttgaattcgaagcgttctactggtaat ggtatcctagggtacgcactgtcaagacttaaccccaacttctacacgtaattgccaaggtgacctgatggagt taaaacctaccgtaatggtaggtgttgccgcagtttgggaaacagtgagaaaaggtatcctggccaagatcaacg aattgcccggttggtctcaaacgcttttctggactgtctatgctttgaaagagagaaatataccatgcagcggcttg ctgagtgggttgatcttcaagagaatcagagaagcaaccggtggaaacttaaggtttattctgaacggtgggtct |

TABLE 1-continued

Amino acid and nucleotide sequences of the disclosure

| SEQ ID | SEQUENCE |
|---|---|
| | gcaatcagcatagacgcccaaaaattcctctccaaccttctatgtcctatgctcattggatatgggctaactgaggg<br>tgtggctaatgcctgtgtcctggagcctgaacattttgattacggtattgctggtgaccttgtcggaactattacagc<br>taaattggtggatgtcgaagatttgggctattttgccaagaataaccaaggtgaattgctgttaaagggtgcaccca<br>tctgttctgaatactataagaatcctgaagaaactgctgcggcctttaccgatgatggctggttccgtaccggtgat<br>atcgctgaatggaccccccaagggacaaattaagatcattgatagaaagaaaaatttggtcaagaccttaaacggt<br>gagtacattgcattggaaaaattagaatccatttacagatcaaatccttacgtccaaaacatctgtgtctacgctgat<br>gaaaacaaagttaagcctgtcggtattgtggtccctaacttaggacacttgtctaagctggctatcgaattaggtat<br>aatggtaccaggtgaagatgtcgaaagctatatccatgaaaagaagctacaggatgccgtttgcaaagatatgct<br>gtcaactgccaaatctcaaggcttgaatggtattgaattattatgtggcattgttttctttgaagaagaatggactcca<br>gaaaacggtcttgttacatccgcccaaaaattaaagagaagagatattctagcggctgtcaagccagatgtggaa<br>agagtttataaagaaaacacttaa |
| SEQ ID NO: 200<br>Sc_FAA4<br>Saccharomyces<br>cerevisiae | MTEQYSVAVGEADNEHETAPRRNIRVKDKPLIRPINSSASTLYEFALEC<br>FTKGGKRDGMAWRDIIDIHETKKTIVKRVDGKDKPIEKTWLYYELTPY<br>ITMTYEEMICVMHDIGRGLIKIGVKPNGENKFHIFASTSHKWMKTFLG<br>CMSQGIPVVTAYDTLGESGLIHSMVETDSVAIFTDNQLLSKLAVPLKTA<br>KNVKFVIHNEPIDPSDKRQNGKLYKAAKDAVDKIKEVRPDIKIYSFDEII<br>EIGKKAKDEVELHFPKPEDPACIMYTSGSTGTPKGVVLTHYNIVAGIGG<br>VGHNVIGWIGPTDRIIAFLPLAHIFELIFEFEAFYWNGILGYATVKTLTPT<br>STRNCQGDLMEFKPTVMVGVAAVWETVRKGILAKINELPGWSQTLF<br>WTVYALKERNIPCSGLLSGLIFKRIREATGGNLRFILNGGSAISIDAQKF<br>LSNLLCPMLIGYGLTEGVANACVLEPEHFDYGIAGDLVGTITAKLVDV<br>EDLGYFAKNNQGELLLKGAPICSEYYKNPEETAAAFTDDGWFRTGDIA<br>EWTPKGQIKIIDRKKNLVKTLNC.EYIALEKLESIYRSNPYVQNICVYAD<br>ENKVKPVGIVVPNLGHLSKLAIELGIMVPGEDVESYIHEKKLQDAVCK<br>DMLSTAKSQGLNGIELLCGIVFFEEEWTPENGLVTSAQKLKRRDILAA<br>VKPDVERVYKENT* |
| SEQ ID NO: 201<br>Mutated acetyl-CoA<br>carboxylase (ACC1)<br>(S659A, S1157A) | atgagcgaagaaagcttattcgagtcttctccacagaagatggagtacgaaattacaaactactcagaaagacat<br>acagaacttccaggtcatttcattggcctcaatacagtagataaactagaggagtccccgttaagggactttgttaa<br>gagtcacggtggtcacacggtcatatccaagatcctgatagcaaataatggtattgccgccgtgaaagaaattag<br>atccgtcagaaaatgggcatacgagacgttcggcgatgacagaaccgtccaattcgtcgccatggccacccca<br>gaagatctggaggccaacgcagaatatatccgtatggccgatcaatacattgaagtgccaggtggtactaataat<br>aacaactacgctaacgtagacttgatcgtagacatcgccgaaagagcagacgtagacgccgtatgggctgct<br>ggggtcacgcctccgagaatccactattgcctgaaaaattgtcccagtctaagaggaaagtcatctttattgggcc<br>tccaggtaacgccatgaggtctttaggtgataaaatctcctctaccattgtcgctcaaagtgctaaagtcccatgtat<br>tccatggtctggtaccggtgttgacaccgttcacgtggacgagaaaaccggtctggtctctgtcgacgatgacat<br>ctatcaaaagggttgttgtacctctcctgaagatggtgttacaaaaggccaagcgtattggttttcctgtcatgattaa<br>ggcatccgaaggtggtggtggtaaaggtatcagacaagttgaacgtgaagaagatttcatcgcttatgccacca<br>ggcagccaacgaaattccaggctcccccattttcatcatgaagttggccggtagagcgcgtcacttggaagttca<br>actgctagcagatcagtacggtacaaatatttccttgttcggtagagactgttccgttcagagacgtcatcaaaaaa<br>ttatcgaagaagcaccagttacaattgccaaggctgaaacatttcacgagatggaaaaggctgccgtcagactg<br>gggaaactagtcggttatgtctctgccggtaccgtggagtatctatattctcatgatgatggaaaattctactttttag<br>aattgaacccaagattacaagtcgagcatccaacaacgaaatggtctccggtgttaacttacctgcagctcaatt<br>acaaatcgctatgggtatccctatgcatagaataagtgacattagaactttatatggtatgaatcctcattctgcctca<br>gaaatcgatttcgaattcaaaactcaagatgccaccaagaacaaagaagacctattccaaagggtcattgtacc<br>gcttgtcgtatcacatcagaagatccaaacgatggattcaagccatcgggtggtactttgcatgaactaaacttcc<br>gttcttcctctaatgtttggggttacttctccgtgggtaacaatggtaatattcactccttttcggactctcagttcggc<br>catatttttgcttttggtgaaaatagacaagcttccaggaaacacatggttgttgccctgaaggaattgtccattagg<br>ggtgattcagaactactggtggaatacttgatcaaacttttggaaactgaagatttcgaggataacactattaccacc<br>ggttggttggacgatttgattactcataaaatgaccgctgaaaagcctgatccaactcttgccgtcatttgcgtgc<br>cgctacaaaggctttcttagcatctgaagaagcccgccacaagtatatcgaatcctacaaaagggacaagttcta<br>tctaaagacctactgcaaactatgttccctgtagattttatccatgagggtaaaagatacaagttcaccgtagctaaa<br>tccggtaatgaccgttacacattatttatcaatggttctaaatgtgatatcatactgcgtcaactatctgatggtggtct<br>tttgattgccataggcggtaaatcgcataccatctattggaagaagaagttgctgctacaagattatccgttgact<br>ctatgactactttgttggaagttgaaaacgatccaaccccagttgcgtactccatccccctggtaaattggtaaattctt<br>ggtggaaaatggtgaacacattatcaagggcaaccatatgcagaaattgaagttatgaaaatgcaaatgcctt<br>ggtttctcaagaaaatggtatcgtccagttattaaagcaacctggttctaccattgttgcaggtgatatcatggctatt<br>atgactcttgacgatccatccaaggtcaagcacgctctaccattttgaaggtatgctgccagatttggttctccagtt<br>atcgaaggaaccaaacctgcctataaattcaagtcattagtgtctactttggaaaacattttgaaggttatgacaa<br>ccaagttattatgaacgcttccttgcaacaattgatagaggttttgagaaatccaaaactgccttactcagaatgga<br>aactacacatctctgctttacattcaagattgcctgctaagctagatgaacaaatggaagagttagttgcacgttcttt<br>gagacgtggtgctgttttcccagctagacaattaagtaaattgattgatatggccgtgaagaatcctgaatacaacc<br>ccgacaaattgctgggcgccgtcgtggaaccattggcggatattgctcataagtactctaacgggttagaagccc<br>atgaacattctatatttgtccatttcttggaagaatattacgaagttgaaaagttattcaatgttccaaatgttcgtgag<br>gaaaatatcattctgaaattgcgtgatgaaaaccctaaagatctagataaagttgcgctaactgttttgtctcattcga<br>aagtttcagcgaagaataacctgatcctagctatcttgaaactattatcaaccattgtgcaagttatcttctaaagtttct<br>gccatttctctactcctctacaacatattgttgaactagaatctaaggctaccgctaaggtcgctctacaagcaaga<br>gaaattttgattcaaggcgctttaccttcggtcaaggaaagaactgaacaaattgaacatatcttaaatcctctgtt<br>gtgaaggttgcctatggctcatccaatccaaagcgctctgaaccagatttgaatatcttgaaggacttgatcgattc<br>taattacgtctgtgttctgatgtttttacttcaattcctaacccatcaagaccccagttgtgactgctgcagctgctcaagtct<br>atattcgtcgtgcttatcgtgcttacaccatagaggatattagagttcacgaaggtgtcacagttccaattgttgaat<br>ggaaattccaactaccttcagctgcgttctccacctttccaactgttaaatctaaaatgggtatgaacagggctgttt<br>ctgtttcagatttgtcatatgttgcaaacagtcagtcatctccgttaagagaaggtatttgatggctgtggatcattta<br>gatgatgttgatgaaattttgtcacaaagtttggaagttattcctcgtcaccaatcttcttctaacggacctgctcctga<br>tcgttctggtagctccgcatcgttgagtaatgttgctaatgtttgtgttgcttctacagaaggtttcgaatctgaagag |

TABLE 1-continued

Amino acid and nucleotide sequences of the disclosure

| SEQ ID | SEQUENCE |
|---|---|
| | gaaattttggtaaggttgagagaaattttggatttgaataagcaggaattaatcaatgcttctatccgtcgtatcacat<br>ttatgttcggttttaaagatgggtcttatccaaagtattatacttttaacggtccaaattataacgaaatgaaacaatt<br>cgtcacattgagccggctttggccttccaactggaattaggaagattgtccaacttcaacattaaaccaattttcact<br>gataatagaaacatccatgtctacgaagctgttagtaagacttctccattggataagagattctttacaagaggtatt<br>attagaacgggtcatatccgtgatgacatttctattcaagaatatctgacttctgaagctaacagattgatgagtgat<br>atattggataatttagaagtcaccgacacttcaaattctgatttgaatcatatcttcatcaacttcattgcggtgtttga<br>tatctctccagaagatgtcgaagccgcctcggtggtttcttagaaagattggtaagagattgttgagattgcgtgtt<br>tcttctgccgaaattagaatcatcatcaaagatcctcaaacaggtgccccagtaccattgcgtgccttgatcaataa<br>cgtttctggttatgttatcaaaaacagaaatgtacaccgaagtcaagaacgcaaaaggtgaatgggtatttaagtctt<br>tgggtaaacctcggatccatgcatttaagaccctattgctactccttaccctgttaaggaatggttgcaaccaaaacgtt<br>ataaggcacacttgatgggtaccacatatgtctatgacttcccagaattattccgccaagcatcgtcatcccaatgg<br>aaaaatttctctgcagatgttaagttaacagatgatttctttatttccaacgagttgattgaagatgaaaacggcgaat<br>taactgaggtggaaagagaacctggtgccaacgctattggtatggttgccttttaagattactgtaaagactcctga<br>atatccaagaggccgtcaatttgttgttgttgctaacgatatcacattcaagatcggttccttttggtccacaagaaga<br>cgaattcttcaataaggttactgaatatgctagaaagcgtggtatcccaagaatttacttggctgcaaactcaggtg<br>ccagaattggtatggctgaagagattgttccactatttcaagttgcatggaatgatgctgccaatccggacaaggg<br>cttccaatacttatacttaacaagtgaaggtatggaaacttttaaagaaatttgacaaagaaaattctgttctcactgaa<br>cgtactgttataaacggtgaagaagattgtcatcaagacaattattggttctgaagatgggttaggtgtcgaatgt<br>ctacgtggatctggtttaattgctggtgcaacgtcaagggcttaccacgatatcttcactatcaccttagtcacttgta<br>gatccgtcggtatcggtgcttatttggttcgtttgggtcaaagagctattcaggtcgaaggccagccaattatttttaa<br>ctggtgctcctgcaatcaacaaaatgctgggtagagaagtttatacttctaacttacaattgggtggtactcaaatca<br>tgtataacaacgtgtttcacatttgactgctgttgacgatttagctggtgtagagaagattgttgaatggatgtcttat<br>gttccagccaagcgtaatatgccagtcctatcttggaaactaaagacacatgggatagaccagttgatttcactcc<br>aactaatgatgaaacttacgatgtaagatggatgattgaaggtcgtgagactgaaagtggatttgaatatggtttgtt<br>tgataaagggtcttttctttgaaactttgtcaggatgggccaaaggtgttgtcgttggtagagcccgtcttggtggtat<br>tccactgggtgttattggtgttgaaacaagaactgtcgagaacttgattcctgctgatccagctaatccaaatagtg<br>ctgaaacattaattcaagaacctggtcaagtttggcatccaaactccgccttcaagactgctcaagctatcaatgac<br>tttaacaacggtgaacaattgccaatgatgattttggccaactggagaggtttctctggtggtcaacgtgatatgttc<br>aacgaagtcttgaagtatggttcgtttattgttgacgcattggtggattacaaacaaccaattattatctatatcccac<br>ctaccggtgaactaagaggtggttcatgggttgttgtcgatccaactatcaacgctgaccaaatggaaatgtatgc<br>cgacgtcaacgctagagctggtgttttggaaccacaagtatggttggtatcaagttccgtagagaaaaattgctg<br>gacaccatgaacgattggatgacaagtacagagaattgagatctcaattatccaacaagagtttggctccagaa<br>gtacatcagcaaatatccaagcaattagctgatcgtgagagagaactattgccaatttacggacaaatcagtcttc<br>aatttgctgatttgcacgataggtcttcacgtatggtggccaaggttgttattttctaaggaactggaatggaccgag<br>gcacgtcgtttcttcttctggagattgagaagaagattgaacgaagaatatttgattaaaaggttgagccatcaggt<br>aggcgaagcatcaagattagaaaagatcgcaagaattagatcgtggtaccctgcttcagtggaccatgaagatg<br>ataggcaagtcgcaacatggattgaagaaaactacaaaactttggacgataaactaaagggtttgaaattagagt<br>cattcgctcaagacttagctaaaaagatcagaagcgaccatgacaatgctattgatggattatctgaagttatcaag<br>atgttatctaccgatgataaagaaaaattgttgaagactttgaaataa |
| SEQ ID NO: 202<br>Truncated<br>geranylgeranyl<br>pyrophosphate<br>synthase<br>Ag_GPPS_Ntrunc | atgtcttttgacttcaataagtatatggattctaaggctatgaccgtcaacgaggctttgaataaagccatcccattg<br>cgttacccacaaaagatctacgaatctatgagatattctttgttagctggtggtaagaagtccgtccagtttttgtgt<br>atcgccgcttgtgaattagtcggtggtactgaggagttagctcattccaaccgcctgtgccatcgaaatgatccaca<br>ccatgtctttgatgcacgatgatttgccatgtatcgacaacgatgacttgagacgtggtaaacctaccaatcataag<br>attttcggtgaagatactgctgttactgccggtaacgctttacactcttacgccttcgaacatattgctgtttctacttc<br>caagactgttggtgctgatagaatttgagaatggtttctgaattaggtcgtgctactggttccgaaggtgttatggg<br>tggtcaaatggtcgatattgcttctgaaggtgacccttccattgatttgcaaactttagaatggatccacatccacaa<br>gactgctatgttattagaatgttctgttgtctgtggtgccatcatcggtggtgcttctgaaattgttattgagagagcc<br>agacgttatgctcgttgtgtcggtttattgtttcaagttgttgacgacatttttagatgttaccaaatcttctgacgaattg<br>ggtaaaactgctggtaaagatttaatctccgataaagccacctaccctaagttgatgggtttggagaaggccaaa<br>gagttttccgatgaattattaaacagagctaaaggtgaattgtcttgcttcgatccagttaaggctgccccattgtta<br>ggtttggctgactacgttgccttcagacaaaactaa |
| SEQ ID NO: 203<br>Truncated<br>geranylgeranyl<br>pyrophosphate<br>synthase<br>Ag_GPPS_Ntrunc | MSFDFNKYMDSKAMTVNEALNKAIPLRYPQKIYESMRYSLLAGGKRV<br>RPVLCIAACELVGGTEELAIPTACAIEMIHTMSLMHDDLPCIDNDDLRR<br>GKPTNHKIFGEDTAVTAGNALHSYAFEHIAVSTSKTVGADRILRMVSE<br>LGRATGSEGVMGGQMVDIASEGDPSIDLQTLEWEHIHKTAMLLECSVV<br>CGAEGGASEIVIERARRYARCVGLLFQWDDILDVTKSSDELGKTAGK<br>DLISDKATYPKLMGLEKAKEFSDELLNRAKGELSCFDPVKAAPLLGLA<br>DYVAFRQN* |
| SEQ ID NO: 204<br>Phosphomevalonate<br>kinase Sc_ERG8<br>Saccharomyces<br>cerevisiae | ttatttatcaagataagtttccggatctttttctttcctaacacccccagtcagcctgagttacatccagccattgaacc<br>ttagaaaatcttttgtcatcagccggtttgagccctaagatcaacatcttgcttagcaatcactgcaatggcgtcataac<br>caccagcaccaggtattaagcaagtaagaactccttttaaggtctggcaatcatccaataagctagtttgtacggg<br>aggttcgatatcggcaccagattctttagttatttttctaaaggaacgtctaattgtggcaactgcatctctaacttctg<br>tgatctcaggatacttttgacaggtacagtcattcctctcaagagactcaaatatctgatcgctgtaatcgtcatgag<br>tctcgtgtaagcgattctagtttagatagtccatccataaatctagaatttgcatgatcgagttctgtatatattttcaag<br>ctttccggcatatgcgaatcataccaatttttttaccttctggaccagtttttactgtttctgaaccattcttaatatcgccc<br>atccataaagttaatcccgaaggtaaatggttacttttaatcgttatattccagtcttcttcattaaccaaatcgccag<br>tttactgccgtaagtagcacttccaatatctggcaaattagagattaatgcgggtgggaatcttctatatctgatagat<br>ccatatgctgccactccatcaaaccgcctccaattttaccctgagcttgacaatgagcaacttgtgataaatt<br>atgaataacttctctatatttgtctacattatttttccaggtccgatacaaaaaggaggccaaagctgtagttaaaact<br>gtgactaaacctgccgaggagcccagccctgttttgggaacttcttcaattctgtgcgaatgaaaactcaatcttct<br>gttgccacgatgttcggtaacgctgtcctcctgagaatggtaggcatcatcagagaaaatatcaataacgaacaa<br>gtttctattgcagtagtcgtccatgttaggcttaaagtagctaaatacgttagcgataacttttcaatgaaagggttct<br>tagatccgcctatcgaaacaggaatgaagccagttttaggacttatatggtacagccactcccatctttaaattgtt |

TABLE 1-continued

Amino acid and nucleotide sequences of the disclosure

| SEQ ID | SEQUENCE |
|---|---|
| | tacttttcacacgcacttcaaacttatcagactcttgcaatgaaccgtaaggatgggctacagcatgcattcttgcc<br>gataatccgactacaaatgcttcatatttcggatctaaaactaaatatccaccagctagtaacgctttccctggggc<br>actgaaggctctcaactctgacat |
| SEQ ID NO: 205<br>Phosphomevalonate<br>kinase Sc_ERG8<br>*Saccharomyces*<br>*cerevisiae* | MSELRAFSAPGKALLAGGYLVLDPKYEAFVVGLSARMHAVAHPYGSL<br>QESDKFEVRVKSKQFKDGEWLYHISPKTGFIPVSIGGSKNPFIEKVIANV<br>FSYFKPNMDDYCNRNLFVIDIFSDDAYHSQEDSVTEHRGNRRLSFHSH<br>RIEEVPKTGLGSSAGLVTVLTTALASFFVSDLENNVDKYREVIHNLSQV<br>AHCQAQGKIGSGFDVAAAAYGSIRYRRFPPALISNLPDIGSATYGSKLA<br>HLVNEEDWNITIKSNHLPSGLTLWMGDIKNGSETVKLVQKVKNWYDS<br>HMPESLKIYTELDHANSRFMDGLSKLDRLHETHDDYSDQIFESLERND<br>CTCQKYPEITEVRDAVATIRRSFRKITKESGADIEPPVQTSLLDDCQTLK<br>GVLTCLIPGAGGYDAIAVIAKQDVDLRAQTADDKRFSKVQWLDVTQA<br>DWGVRKEKDPETYLDK* |
| SEQ ID NO: 206<br>Mevalonate kinase<br>Erg12 *Saccharomyces*<br>*cerevisiae* | atgtcattaccgttcttaacttctgcaccgggaaaggttattattttggtgaacactctgctgtgtacaacaagcctg<br>ccgtcgctgctagtgtcgcgttgagaacctacctgctaataagcgagtcatctgcaccagatactattgaattg<br>gactcccggacattagctttaatcataagtggtccatcaatgatttcaatgccatcaccgaggatcaagtaaactc<br>ccaaaaattggccaaggctcaacaagccaccgatggcttgtctcaggaactcgttagtcttttggatccgttgttag<br>ctcaactatccgaatccttccactaccatgcagcgttttgtttcctgtatatgtttgtttgcctatgccccatgccaag<br>aattataagttttctttaaagtctactttacccatcggtgctgggttgggctcaagcgcctctatttctgtatcactggc<br>cttagctatggcctacttgggggggttaataggatctaatgacttggaaaagctgtcagaaaacgataagcatata<br>gtgaatcaatgggccttcataggtgaaaagtgtattcacggtaccccttcaggaatagataacgctgtggccactt<br>atggtaatgccctgctatttgaaaaagactcacataatggaacaataaacacaaacaattttaagttcttagatgattt<br>cccagccattccaatgatcctaacctatactagaattccaaggtctacaaaaagatcttgttgctcgcgttcgtgtgtt<br>ggtcaccgagaaatttcctgaagttatgaagccaattctagatgccatgggtgaatgtgccctacaaggcttagag<br>atcatgactaagttaagtaaatgtaaaggcaccgatgacgaggctgtagaaactaataatgaactgtatgaacaa<br>ctattggaattgataagaataaatcatggactgcttgtctcaatcggtgtttctcatcctggattagaacttattaaaaa<br>tctgagcgatgatttgagaattggctccacaaaacttaccggtgctggtggcggcggttgctctttgactttgttac<br>gaagagacattactcaagagcaaattgacagtttcaaaaagaaattgcaagatgattttagttacgagacatttgaa<br>acagacttgggtgggactggctgctgtttgttaagcgcaaaaaatttgaataaagatcttaaaatcaaatccctagt<br>attccaattatttgaaaataaaactaccacaaagcaacaaattgacgatctattattgccaggaaacacgaatttac<br>catggacttcataa |
| SEQ ID NO: 207<br>Mutated acetyl-CoA<br>carboxylase (ACC1)<br>(S659A, S1157A) | MSEESLFESSPQKMEYEITNYSERHTELPGHFIGLNTVDKLEESPLRDFV<br>KSHGGHTVISKILIANNGIAAVKEIRSVRKWAYETFGDDRTVQFVAMA<br>TPEDLEANAEYIRMADQYIEVPGGTNNNNYANVDLIVDIAERADVDA<br>VWAGWGHASASENPLLPEKLSQSKRKVIFIGPPGNAMRSLGDKISSSTIVAQ<br>SAKVPCIPWSGTGVDTVHVDEKTGLVSVDDDIYQKGCCTSPEDGLQK<br>AKRIGFPVMIKASEGGGGKGIRQVEREEDFIALYHQAANEIPGSPIFIMK<br>LAGRARHLEVQLLADQYGTNISLFGRDCSVQRRHQKIIEEAPVTIAKAE<br>TFHEMEKAAVRLGKLVGYVSAGTVEYLYSHDDGKFYFLELNPRLQVE<br>HPTTEMVSGVNLPAAQLQIAMGIPMHRISDIRTLYGMNPHSASEIDFEF<br>KTQDATKKQRRPIPKGHCTACRITSEDPNDGFKPSGGTLHELNFRSSSN<br>VWGYFSVGNNGNIHSFSDSQFGHIFAFGENRQASRKHMVVALKELSIR<br>GDFRTTVEYLIKLLETEDFEDNTITTGWLDDLITHKMTAEKPDPTLAVI<br>CGAATKAFLASEEARHKYIESLQKGQVLSKDLLQTMFPVDFIHEGKRY<br>KFTVAKSGNDRYTLFINGSKCDIILRQLSDGGLLIAIGGKSHTIYWKEEV<br>AATRLSVDSMTTLLEVENDPTQLRTPSPGKLVKFLVENGEHIIKGQPYA<br>EIEVMKMQMPLVSQENGIVQLLKQPGSTIVAGDIMAIMTLDDPSKVKH<br>ALPFEGMLPDFGSPVIEGTKPAYKFKSLVSTLENILKGYDNQVIMNASL<br>QQLIEVLRNPKLPYSEWKLHISALHSRLPAKLDEQMEELVARSLRRGA<br>VFPARQLSKLIDMAVKNPEYNPDKLLGAVVEPLADIAHKYSNGLEAHE<br>HSIFVHFLEEYYEVEKLFNGPNVREENIILKLRDENPKDLDKVALTVLS<br>HSKVSAKNNLILAILKHYQPLCKLSSKVSAIFSTPLQHIVELESKATAKV<br>ALQAREILIQGALPSVKERTEQIEHILKSSVVKVAYGSSNPKRSEPDLNI<br>LKDLIDSNYVVFDVLLQFLTHQDPVVTAAAAQVYIRRAYRAYTIGDIR<br>VHEGVTVPIVEWKFQLPSAAFSTFPTVKSKMGMNRAVSVSDLSYVAN<br>SQSSPLREGILMAVDHLDDVDEILSQSLEVIPRHQSSSNGPAPDRSGSSA<br>SLSNVANVCVASTEGFESEEEILVRLREILDLNKQELINASIRRITFMFGF<br>KDGSYPKYYTFNGPNYNENETIRHIEPALAFQLELGRLSNFNIKPIFTDN<br>RNIHVYEAVSKTSPLDKRFFTRGIIRTGHIRDDISIQEYLTSEANRLMSDI<br>LDNLEVTDTSNSDLNHIFINFIAVFDISPEDVEAAFGGFLERFGKRLLRL<br>RVSSAEIRIIIKDPQTGAPVPLRALINNVSGYVIKTEMYTEVKNAKGEW<br>VFKSLGKPGSMHLRPIATPYPVKEWLQPKRYKAHLMGTTYVYDFPEL<br>FRQASSSQWKNFSADVKLTDDFFISNELIEDENGELTEVEREPGANAIG<br>MVAPFKITVKTPEYPRGRQFVVVANDITFKIGSFGPQEDEFFNKVTEYAR<br>KRGIPRIYLAANSGARIGMAEEIVPLFQVAWNDAANPDKGFQYLYLTS<br>EGMETLKKFDKENSVLTERTVINGEERFVIKTIIGSEDGLGVECLRGSG<br>LIAGATSRAYHDIFTITLVTCRSVGIGAYLVRLGQRAIQVEGQPIILTGA<br>PAINKMLGREVYTSNLQLGGTQIMYNNGVSHLTAVDDLAGVEKIVEW<br>MSYVPAKRNMPVPILETKDTWDRPVDFTPTNDETYDVRWMIEGRETE<br>SGFEYGLFDKGSFFETLSGWAKGVVVGRARLGGIPLGVIGVETRTVEN<br>LIPADPANPNSAETLIQEPGQVWHPNSAFKTAQAINDFNNGEQLPMMIL<br>ANWRGFSGGQRDMFNEVLKYGSFIVDALVDYKQPIIIYIPPTGELRGGS<br>WVVVDPTINADQMEMYADVNARAGVLEPQGMVGIKFRREKLLDTM |

TABLE 1-continued

Amino acid and nucleotide sequences of the disclosure

| SEQ ID | SEQUENCE |
|---|---|
| | NRLDDKYRELRSQLSNKSLAPEVHQQISKQLADRERELLPIYGQISLQF<br>ADLHDRSSRMVAKGVISKELEWTEARRFFFWRLRRRLNEEYLIKRLSH<br>QVGEASRLEKIARIRSWYPASVDHEDDRQVATWIEENYKTLDDKLKG<br>LKLESFAQDLAKKIRSDHDNAIDGLSEVIKMLSTDDKEKLLKTLK* |
| SEQ ID NO: 208<br>Truncated 3-hydroxy-<br>3-methyl-glutaryl-<br>CoA reductase<br>(Sc_tHMG1) | MQLVKTEVTKKSFTAPVQKASTPVLTNKTVISGSKVKSLSSAQSSSSGP<br>SSSSEEDDSRDIESLDKKIRPLEELEALLSSGNTKQLKNKEVAALVIHGK<br>LPLYALEKKLGDTTRAVAVRRKALSILAEAPVLASDRLPYKNYDYDR<br>VFGACCENVIGYMPLPVGVIGPLVIDGTSYHIPMATTEGCLVASAMRG<br>CKAINAGGGATTVLTKDGMTRGPWRFPTLKRSGACKIWLDSEEGQN<br>AIKKAFNSTSRFARLQHIQTCLAGDLLFMRFRTTTGDAMGMNMISKGV<br>EYSLKQMVEEYGWEDMEVVSVSGNYCTDKKPAAINWIEGRGKSVVA<br>EATIPGDVVRKVLKSDVSALVELNIAKNLVGSAMAGSVGGFNAHAAN<br>LVTAVFLALGQDPAQNVESSNCITLMKEVDGDLRISVSMPSIEVGTIGG<br>GTVLEPQGAMLDLLGVRGPHATAPGTNARQLARIVACAVLAGELSLC<br>AALAAGHLVQSHMTHNRKPAEPTKPNNLDATDINRLKDGSVTCIKS* |
| SEQ ID NO: 209<br>Erg10p: acetoacetyl<br>CoA thiolase<br>[Saccharomyces<br>cerevisiae]. | atgtctcagaacgtttacattgtatcgactgccagaaccccaattggttcattccaggttctctatcctccaagaca<br>gcagtggaattgggtgctgttgctttaaaaggcgccttggctaaggttccagaattggatcatccaaggattttga<br>cgaaattatttttggtaacgttcttctgccaatttgggccaagctccggccagacaagttgctttggctgccggtttg<br>agtaatcatatcgttgcaagcacagttaacaaggtctgtgcatccgctatgaaggcaatcattttgggtgctcaatc<br>catcaaatgtgtaatgctgatgttgtcgtagctggtggttgtgaatctatgactaacgcaccatactacatgccag<br>cagcccgtgcgggtgccaaattggccaaactgttcttgttgatggtgtcgaaagagatgggtgaacgatgcgt<br>acgatggtctagccatgggtgtacacgcagaaaagtgtgcccgtgattgggatattactagagaacaacaagac<br>aattttgccatcgaatcctaccaaaaatctcaaaaatctcaaaaggaaggtaaattcgacaatgaaattgtacctgtt<br>accattaagggatttagaggtaagcctgatactcaagtcacgaaggcgaggaacctgctagattacacgttgaa<br>aaattgagatctgcaaggactgttttccaaaaagaaaacggtactgttactgccgctaacgcttctccaatcaacg<br>atggtgctgcagccgtcatcttggttccgaaaaagttttgaaggaaaagaatttgaagcctttggctattatcaaag<br>gttggggtgaggccgctcatcaaccagctgattttacatgggctccatctcttgcagttccaaaggctttgaaacat<br>gctggcatcgaagacatcaattctgttgattacttttgaattcaatgaagcctttttcggttgtcggtttggtgaacacta<br>agattttgaagctagacccatctaaggttaatgtatatggtggtgctgttgctctaggtcacccattgggttgttctgg<br>tgctagagtggttgttacactgctatccatcttacagcaagaaggaggtaagatcggtgttgccgccatttgtaatg<br>gtggtggtggtgcttcctctattgtcattgaaaagatatga |
| SEQ ID NO: 210<br>Artificial<br>truncated<br>geranyl<br>pyrophosphate<br>olivetolic acid<br>geranyltransferase<br>CsPT4_t112 | atgtcttacgttgtcaagggtatgatctctattgcttgtggttttgttcggtagagaattgtttaacaacagacacttgt<br>tctcttgggggtttgatgtggaaagcttcttcgctttggtcccaatttttgtctttcaatttcttcgccgccatcatgaa<br>ccaaatctacgatgttgatatcgaccgtatcaacaagccagacttaccttagtttccggtgaaatgtccattgaactg<br>cttggatcttgtctatcattgttgccttgactggtttaattgttactattaagttgaagtccgctccattgtttgtcct<br>catctacatcttcggtatcttcgctggtttcgcttactccgtcccacctattagatggaaacaatatcctttaccaatt<br>tcttgatcactatttcctctcatgttggtttggctttcacttcttactctgccaccacttctgctttaggtttgcctttc<br>gtttggcgtcctgccttctctttcattattgctttcatgactgtcatgggtatgactattgcctttgctaaagacatttt<br>ctgatatcgaaggtgatgctaagtacggtgtctctaccgttgctaccaagttaggtgctagaaatatgactttttgtt<br>tctggtgtcttattgttgaactacttggtttctatctctattggtatcatttggccacaagttttcaagtctaacatta<br>tgatcttgtctcatgctatttttggctttctgtttgatctttcaaactcgtgaattagccttagccaattatgcctctgcc<br>catcccgtcaattttttcgaattcatctggttgttatactatgccgaatacttcgtttacgtcttcatttaa |
| SEQ ID NO: 211<br>Truncated geranyl<br>pyrophosphate<br>olivetolic acid<br>geranyltransferase<br>CsPT4_t112 | MSYVVKGMISIACGLFGRELFNNRHLFSWGLMWKAFFALVPILSFNFF<br>AAIMNQIYDVDIDRINKPDLPLVSGEMSIETAWILSIIVALTGLIVTIKLK<br>SAPLFVFIYIFGIFAGFAYSVPPIRWKQYPFTNFLITISSHVGLAFTSYSAT<br>TSALGLPFVWRPAFSFILAFMTVMGMTLAFAKDISDIEGDAKYGVSTVA<br>TKLGARNMTFVVSGVLLLNYLVSISIGIIWPQVFKSNIMILSHAILAFCLI<br>FQTRELALANYASAPSRQFFEFIWLLYYAEYFVYVFI |
| SEQ ID NO: 212<br>Artificial<br>truncated geranyl<br>pyrophosphate<br>olivetolic acid<br>geranyltransferase<br>CsPT4_t131<br>nucleotide sequence | atgtctaacaacagacacttgttctcttgggggtttgatgtggaaagcttcttcgctttggtcccaatttttgtctttcaa<br>tttcttcgccgccatcatgaaccaaatctacgatgttgatatcgaccgtatcaacaagccagacttaccttagtttccg<br>gtgaaatgtccattgaactgcttggatcttgtctatcattgttgccttgactggtttaattgttactattaagttgaagt<br>ccgctccattgtttgtcttcatctacatcttcggtatcttcgctggtttcgcttactccgtcccacctattagatggaaa<br>caatatcctttaccaatttcttgatcactatttcctctcatgttggtttggctttcacttcttactctgccaccacttc<br>tgctttaggtttgcctttcgtttggcgtcctgccttctctttcattattgctttcatgactgtcatgggtatgactattgc<br>ctttgctaaagacatttctgatatcgaaggtgatgctaagtacggtgtctctaccgttgctaccaagttaggtgctagaa<br>atatgactttttgttgtttctggtgtcttattgttgaactacttggtttctatctctattggtatcatttggccacaagttt<br>tcaagtctaacattatgatcttgtctcatgctatttttggctttctgtttgatctttcaaactcgtgaattagccttagc<br>caattatgcctctgccccatcccgtcaattttttcgaattcatctggttgttatactatgccgaatacttcgtttacgtct<br>tcatttaa |
| SEQ ID NO: 213<br>Truncated geranyl<br>pyrophosphate<br>olivetolic acid<br>geranyltransferase<br>CsPT4_t131 | MSNNRHLFSWGLMWKAFFALVPILSFNFFAAIMNQIYDVDIDRINKPD<br>LPLVSGEMSIETAWILSIIVALTGLIVTIKLKSAPLFVFIYIFGIFAGFAYS<br>VPPIRWKQYPFTNFLITISSHVGLAFTSYSATTSALGLPFVWRPAFSIIA<br>FMTVMGMTIAFAKDISDIEGDAKYGVSTVATKLGARNMTFVVSGVLL<br>LNYLVSISIGIIWPQVFKSNIMILSHAILAFCUFQTRELALANYASAPSR<br>QFFEFIWLLYYAEYFVYVFI |
| SEQ ID NO: 214<br>Artificial<br>truncated geranyl<br>pyrophosphate | atgtcttggaaagctttcttcgctttggtcccaatttttgtctttcaatttcttcgccgccatcatgaaccaaatctacgat<br>gttgatatcgaccgtatcaacaagccagacttaccttagtttccggtgaaatgtccattgaactgcttggatcttgt<br>ctatcattgttgccttgactggtttaattgttactattaagttgaagtccgctccattgtttgtcttcatctacatcttcg<br>gtatcttcgctggtttcgcttactccgtcccacctattagatggaaacaatatcctttaccaatttcttgatcactatt |

TABLE 1-continued

Amino acid and nucleotide sequences of the disclosure

| SEQ ID | SEQUENCE |
|---|---|
| olivetolic acid geranyltransferase CsPT4_t142 nucleotide sequence | tcctctcatgttggtttggctttcacttcttactctgccaccacttctgctttaggtttgcctttcgtttggcgtcctgc cttctctttcattattgctttcatgactgtcatgggtatgactattgcctttgctaaagacatttctgatatcgaaggtg atgctaagtacggtgtctctaccgttgctaccaagttaggtgctagaaatatgacttttgttgtttctggtgtcttattgt tgaactacttggtttctatctctattggtatcatttggccacaagttttcaagtctaacattatgatcttgtctcatgct attttggctttctgtttgatcttttcaaactcgtgaattagccttagccaattatgcctctgccccatcccgtcaatttttc gaattcatctggttgttatactatgccgaatacttcgtttacgtcttcatttaa |
| SEQ ID NO: 215 Truncated geranyl pyrophosphate olivetolic acid geranyltransferase CsPT4_t142 | MSWKAFFALVPILSFNFFAAIMNQIYDVDIDRINKPDLPLVSGEMSIETA WILSIIVALTGLIVTIKLKSAPLFVFIYIFGIFAGFAYSVPPIRWKQYPFTN FLITISSHVGLAFTSYSATTSALGLPFVWRPAFSFIIAFMTVMGMTIAFA KDISDIEGDAKYGVSTVATKLGARNMTFVVSGVLLLNYLVSISIGIIWP QVFKSNIMILSHAILAFCLIFQTRELALANYASAPSRQFFEFIWLLYYAE YFVYVH |
| SEQ ID NO: 216 Artificial truncated geranyl pyrophosphate olivetolic acid geranyltransferase CsPT4_t166 nucleotide sequence | Atgtctgatgttgatatcgaccgtatcaacaagccagacttacctttagtttccggtgaaatgtccattgaaactgcttg gatcttgtctatcattgttgccttgactggtttaattgttactattaagttgaagtccgctccattgtttgtcttcatcta catcttcggtatctttgctggtttcgcttactccgtcccacctattagatggaaacaatatcctttttaccaatttcttgat cactatttcctctcatgttggtttggctttcacttcttactctgccaccacttctgctttaggtttgcctttcgtttggcg tcctgccttctctttcattattgctttcatgactgtcatgggtatgactattgcctttgctaaagacatttctgatatcg aaggtgatgctaagtacggtgtctctaccgttgctaccaagttaggtgctagaaatatgacttttgttgtttctggtgtct tattgttgaactacttggtttctatctctattggtatcatttggccacaagttttcaagtctaacattatgatcttgtct catgctattttggctttctgtttgatcttttcaaactcgtgaattagccttagccaattatgcctctgccccatcccgtca atttttcgaattcatctggttgttatactatgccgaatacttcgtttacgtcttcatttaa |
| SEQ ID NO: 217 Truncated geranyl pyrophosphate olivetolic acid geranyltransferase CsPT4_t166 | MSDVDIDRINKPDLPLVSGEMSIETAWILSIIVALTGLIVTIKLKSAPLFV FIYIFGIFAGFAYSVPPIRWKQYPFTNFLITISSHVGLAFTSYSATTSALGL PFVWRPAFSFIIAFMTVMGMTIAFAKDISDIEGDAKYGVSTVATKLGAR NMTFVVSGVLLLNYLVSISIGIIWPQVFKSNIMILSHAILAFCLIFQTREL ALANYASAPSRQFFEFIWLLYYAEYFVYVFI |
| SEQ ID NO: 218 Artificial truncated geranyl pyrophosphate olivetolic acid geranyltransferase CsPT4_t186 nucleotide sequence | atgtctattgaaactgcttggatcttgtctatcattgttgccttgactggtttaattgttactattaagttgaagtccgc tccattgtttgtcttcatctacatcttcggtatcttcgctggtttcgcttactccgtcccacctattagatggaaacaa tatcctttttaccaatttcttgatcactatttcctctcatgttggtttggctttcacttcttactctgccaccacttcg ctttaggtttgcctttcgtttggcgtcctgccttctctttcattattgctttcatgactgtcatgggtatgactattgcc tttgctaaagacatttctgatatcgaaggtgatgctaagtacggtgtctctaccgttgctaccaagttaggtgctagaa atatgacttttgttgtttctggtgtcttattgttgaactacttggtttctatctctattggtatcatttggccacaagtt ttcaagtctaacattatgatcttgtctcatgctattttggctttctgtttgatcttttcaaactcgtgaattagccttag ccaattatgcctctgccccatcccgtcaatttttcgaattcatctggttgttatactatgccgaatacttcgtttacgtc ttcatttaa |
| SEQ ID NO: 219 Truncated geranyl pyrophosphate olivetolic acid geranyltransferase CsPT4_t186 | MSIETAWILSIIVALTGLIVTIKLKSAPLFVFIYIFGIFAGFAYSVPPIRWK QYPFTNFLITISSHVGLAFTSYSATTSALGLPFVWRPAFSFIIAFMTVMG MTIAFAKDISDIEGDAKYGVSTVATKLGARNMTFVVSGVLLLNYLVSI SIGIIWPQVFKSNIMILSHAILAFCLIFQTRELALANYASAPSRQFFEFIWL LYYAEYFVYVFI |
| SEQ ID NO: 220 Artificial geranyl pyrophosphate olivetolic acid geranyltransferase CsGOT (CsPT1) nucleotide sequence | atgggtttatcttccgtttgtactttttctttccaaactaactaccacactttgttaaatccacacaacaacaaccctaa aacctccttgttatgttacagacacccaaagacccctattaaatactcctacaacaacttcccatccaaacactgctc cactaagtcctttcacttgcaaaacaagtgttctgaatccttgtccattgccaagaactctattcgtgccgctactact aaccaaactgagccacctgaatccgataaccactccgtcgccaccaagatcttgaattttggtaaagcttgctggaaatt gcaaagaccatacactattattgctttcactcctgtgcttgtggtttattcggtaaggaattattgcataacaccaact tgatttcttggtccttaatgtcaaagccttcttcttttagttgccatttttatgtattgcttcttcactactactatta atcaaatttacgatttgcacattgacagaatcaataagcctgacttgccattagcttccggtgaaatttctgttaacactg cttggatcatgtccatcattgtcgctttgttcggtttaattatcaccatcaaaatgaagggtggtcctttgtacatcttcg gttattgcttcggtattttcggtggtattgtctactctgtcccaccattcagatggaagcaaaacccatccactgcctttt tgttgaatttcttggctcacatcattaccaattttacttttctactatgcctcccgtgctgctttaggtttgcctttgagt tacgtccatcccttcactttttattggcttttatgaagtccatgggttctgctttagccttaattaaggacgcctctgacg ttgaaggtgatactaagttcggtatctctactttagcctcaagtacggttctcgtaacttgaccttgttctgttctggta ttgtcttgttgtcttacgtcgccgctattttggccggtatcatctggccacaagctttcaactctaacgttatgttgttgt ctcatgctatcttagctttctggttgatcttacaaaccagagacttcgctttgactaactacgacccagaagccggtc gtagattctacgaattcatgtggaaattgtactacgccgagtacttggtctacgtttttcatttag |
| SEQ ID NO: 221 Artificial truncated geranyl pyrophosphate olivetolic acid geranyltransferase CsPT4t nucleotide sequence | atgtctgctggctctgaccaaattgaaggttccccgcatcacgaatcagataatagtattgccacaaagatcttaaa cttttgggcatacatgttggaaattacaaaggcccacgtcgtcaaaggaatgataagcatcgcttgcggtctgttc ggaagggaattatttaacaataggcatctattcagctggggggttaatgtggaaagctttcttcgcgttagtgccaat cctaagcttttaacttttttcgccgccatcatgaaccagatttatgatgttgatatcgacaggataaataagccagatctt ccattggtatccggtgaaatgtccattgaaactgcttggatattgtctattatatcgtgcgctgacctgatagtaa caatcaaatttgaaatctgcacccctgtttgtttttatatatatattttgattttcgctggattcgcttactcagtgccac ctatcaggtggaagcagtacccattcacgaatttttctgatcacgatctctagccacgtcgggttagcgttcacatctt actctgcaaccacgagtgccttgggcttcctttcgtctggcgtccagcttttagttttatcattgcctttatgaccgta atgggaatgacgatcgcattcgcaaaggacatttctgacatagaggggatgcaaaatacggtgtctccactgtg gcgacaaaattaggagctaggaatatgactttcgtggtgtccggtgtattattactaaaattatcggtatctataagta |

TABLE 1-continued

Amino acid and nucleotide sequences of the disclosure

| SEQ ID | SEQUENCE |
|---|---|
| | tcggcatcatatggccgcaagtgtttaaatccaacattatgatactgagtcatgctattttggcttttttgtctgattttc<br>agacgcgtgagttggcgcttgcaaactatgcctctgcgcccagcaggcagttttttgaattcatatggttattgtact<br>atgccgagtatttcgtctacgtatttatttaa |
| SEQ ID NO: 222<br>Artificial<br>truncated geranyl<br>pyrophosphate<br>olivetolic acid<br>geranyltransferase<br>CsGOT_t75 (CsPT1_t75)<br>nucleotide sequence | atgtctgccgctactactaaccaaactgagccacctgaatccgataaccactccgtcgccaccaagatcttgaatttt<br>ggtaaagcttgctggaaattgcaaagaccatacactattattgctttcacttcctgtgcttgtggtttattcggtaag<br>gaattattgcataacaccaacttgatttcttggtccttaatgttcaaagccttcttcttttttagttgccattttatgta<br>ttgcttctttcactactactattaatcaaatttacgatttgcacattgacagaatcaataagcctgacttgccattag<br>cttccggtgaaatttctgttaacactgcttggatcatgtccatcattgtcgcttttgttcggtttaattatcaccatcaa<br>aatgaagggtggtcctttgtacatcttcggttattgcttcggtattttcggtggtattgtctactctgtcccaccatt<br>cagatggaagcaaaacccatccactgccttttttgttgaatttcttggctcacatcattaccaattttactttctacta<br>tgcctcccgtgctgctttaggtttgccttttgagttacgtccatccttcactttttattggcttttatgaagtccatg<br>ggttctgctttagccttaattaaggacgcctctgacgttgaaggtgatactaagttcggtatctctactttagcctctaa<br>gtacggttctcgtaacttgaccttgttctgttctggtattgtcttgttgtcttacgtcgccgctattttggccggtatc<br>atctggccacaagctttcaactctaacgttatgttgttgtctcatgctatcttagctttctggttgatcttacaaacc<br>agagacttcgctttgactaactacgacccagaagccggtcgtagattctacgaattcatgtggaaattgtactacgcc<br>gagtacttggtctacgttttcatttag |
| SEQ ID NO: 223<br>Truncated geranyl<br>pyrophosphate<br>olivetolic acid<br>geranyltransferase<br>CsGOT_t75 (CsPT1_t75) | MSAATTNQTEPPESDNHSVATKILNFGKACWKLQRPYTIIAFTSCACGL<br>FGKELLHNTNLISWSLMFKAFFFLVAILCIASFTTTINQIYDLHIDRINKP<br>DLPLASGEISVNTAWIMSIIVALFGLIITIKMKGGPLYIFGYCFGIFGGIV<br>YSVPPFRWKQNPSTAFLLNFLAHIITNFTFYYASRAALGLPFELRPSFTF<br>LLAFMKSMGSALALIKDASDVEGDTKFGISTLASKYGSRNLTLFCSGIV<br>LLSYVAAILAGIIWPQAFNSNVMLLSHAILAFWLILQTRDFALTNYDPE<br>AGRRFYEFMWKLYYAEYLVYVFI |
| SEQ ID NO: 224<br>Artificial<br>truncated geranyl<br>pyrophosphate<br>olivetolic acid<br>geranyltransferase<br>CsPT4_t76 (CsPT4t)<br>nucleotide sequence | Atgtccgccggttctgatcaaatcgaaggttccctcatcatgagtccgataactccattgctactaaaattttaaatt<br>tcggtcatacttgttggaagttgcaacgtccttacgttgtcaagggtatgatctctattgcttgtggtttgttcggtag<br>agaattgtttaacaacagacacttgttctcttggggtttgatgtggaaagcttcttcgctttggtcccaatttgtctt<br>tcaatttcttcgccgccatcatgaaccaaatctacgatgttgatatcgaccgtatcaacaagccagacttaccttagtt<br>ccggtgaaatgtccattgaaactgcttggatcttgtctatcattgttgccttgactggttaattgttactattaagttga<br>agtccgctccattgtttgtcttcatctacatcttcggtatcttcgctggtttcgcttactccgtcccacctattagatgga<br>aacaatatccttttaccaatttcttgatcactatttcctctcatgttggtttggctttcacttcttactctgccaccact<br>tctgctttaggtttgccttttcgtttggcgtcctgccttctcttcattattgctttcatgactgtcatgggtatgactatt<br>gcctttgctaaagacatttctgatatcgaaggtgatgctaagtacggtgtctctaccgttgctaccaagttaggtgctaga<br>aatatgacttttgttgtttctggtgtcttattgttgaactacttggtttctatctctattggtatcatttggccacaagt<br>tttcaagtctaacattatgatcttgtctcatgctattttggctttctgtttgatctttcaaactcgtgaattagccttagc<br>caattatgcctctgccccatcccgtcaatttttcgaattcatctggttgttatactatgccgaatacttcgtttacgtc<br>ttcatttaa |
| SEQ ID NO: 225<br>Geranyl<br>pyrophosphate<br>olivetolic acid<br>geranyltransferase<br>CsPT4<br>Cannabis sativa | atgggactctcattagtttgtaccttttcatttcaaactaattatcatactttattaaaccctcataataagaatcccaaa<br>aactcattattattcttatcaacaccccaaaacaccaataattaaatcctcttatgataattttccctctaaatattgctt<br>aaccaagaacttcatttacttggactcaattcacacaacagaataagctcacaatcaaggtccattagggcaggtag<br>cgatcaaattgaaggttctcctcatcatgaatctgataattcaatagcaactaaaattttaaattttggacatacttgtt<br>ggaaacttcaaagaccatatgtagtaaaagggatgatttcaatcgcttgtggtttgtttgggagagagttgttcaata<br>acagacatttattcagttggggtttgatgtggaaggcattcttcgctttggtgcctatattgtccttcaatttcttgcag<br>caatcatgaatcaaatttacgatgtggacatcgacaggataaacaagcctgatctaccactagtttcaggggaaat<br>gtcaattgaaacagcttggattttgagcataattgtggcactaactgggttgatagtaactataaaattgaaatctgcac<br>cacttttgttttcatttacattttggtatatttgctgggtttgcctattctgttccaccaattagatggaagcaatatc<br>ctttaccaattttctaattaccatatcgagtcatgtgggcttagctttcacatcatattctgcaaccacatcagctcttg<br>gtttaccatttgtgtggaggcctgcttttagtttcatcatagcattcatgacagttatgggtatgactattgcttttgcca<br>aagatatttcagatattgaaggcgacgccaaatatggggtatcaactgttgcaaccaaattaggtgctaggaacatga<br>catttgttgtttctggagttcttcttctaaactacttggtttctatatctattgggataatttggcctcaggttttcaaga<br>gtaacataatgatactttctcatgcaatcttagcattttgcttaatcttccagactcgtgagcttgctctagcaaattac<br>gcctcggcgccaagcagacaattcttcgagtttatctggttgctatattatgctgaatactttgtatatgtatttatataa |

EXAMPLES

The following examples are put forth so as to provide those of ordinary skill in the art with a complete disclosure and description of how to make and use the present disclosure, and are not intended to limit the scope of what the inventors regard as their disclosure nor are they intended to represent that the experiments below are all or the only experiments performed. Efforts have been made to ensure accuracy with respect to numbers used (e.g. amounts, temperature, etc.) but some experimental errors and deviations should be accounted for. Unless indicated otherwise, parts are parts by weight, molecular weight is weight average molecular weight, temperature is in degrees Celsius, and pressure is at or near atmospheric. Standard abbreviations may be used, e.g., bp, base pair(s); kb, kilobase(s); s or sec, second(s); min, minute(s); h or hr, hour(s); aa, amino acid(s); kb, kilobase(s); bp, base pair(s); nt, nucleotide(s); and the like.

General Methods of the Examples

Yeast Transformation Methods

Each DNA construct comprising one or more heterologous nucleic acids disclosed herein (e.g., constructs detailed in Table 11) was integrated into *Saccharomyces cerevisiae* (CEN.PK2) with standard molecular biology techniques in an optimized lithium acetate (LiAc) transformation. Briefly, cells were grown overnight in yeast extract peptone dextrose (YPD) media at 30° C. with shaking (200 rpm), diluted to an OD600 of 0.1 in 100 mL YPD, and grown to an OD600 of 0.6-0.8. For each transformation, 5 mL of culture was harvested by centrifugation, washed in 5 mL of sterile water, spun down again, resuspended in 1 mL of 100 mM LiAc, and transferred to a microcentrifuge tube. Cells were spun down (13,000×g) for 30 seconds, the supernatant was removed, and the cells were resuspended in a transformation mix consisting of 240 µL, 50% PEG, 36 µL 1M LiAc, 10 µL boiled salmon sperm DNA, and 74 µL of donor DNA. Following a heat shock at 42° C. for 40 minutes, cells were recovered overnight in YPD media before plating on selective media. DNA integration was confirmed by colony PCR with primers specific to the integrations.

Yeast Culturing Conditions

Yeast colonies verified to contain the expected DNA assembly comprising one or more heterologous nucleic acids disclosed herein, genetically modified host cells, were picked into 96-well microtiter plates containing 360 µL of YPD (10 g/L yeast extract, 20 g/L Bacto peptone, 20 g/L dextrose (glucose)) and sealed with a breathable film seal. Cells were cultured at 30° C. in a high capacity microtiter plate incubator shaking at 1000 rpm and 80% humidity for 3 days until the cultures reached carbon exhaustion. The growth-saturated cultures were subcultured into fresh plates containing YPGAL and either olivetolic acid or hexanoic acid, or an olivetolic acid derivative or a carboxylic acid other than hexanoic acid (10 g/L yeast extract, 20 g/L Bacto peptone, 20 g/L galactose, 1 g/L glucose and either 1 mM olivetolic acid or 2 mM hexanoic acid, or 1 mM of an olivetolic acid derivative or 2 mM of a carboxylic acid other than hexanoic acid), by taking 14.4 µL from the saturated cultures and diluting into 360 µL of fresh media and sealed with a breathable film seal. Genetically modified host cells in the production media were cultured at 30° C. in a high capacity microtiter plate shaker at 1000 rpm and 80% humidity for an additional 3 days prior to extraction and analysis. Upon completion, 100 µL of whole cell broth was diluted into 900 µL of methanol, sealed with a foil seal, and shaken at 1500 rpm for 60 seconds to extract the cannabinoids, cannabinoid derivatives, cannabinoid precursors, or cannabinoid precursor derivatives. After shaking, the plate was centrifuged at 1000×g for 60 seconds to remove any solids. After centrifugation, 12 µL of supernatant was transferred to a fresh assay plate containing 228 µL of methanol, sealed with a foil seal, shaken for 60 seconds at 900 rpm, and analyzed by LC-MS.

Analytical Methods

Samples were analyzed by C-MS mass spectrometer (Agilent 6470) using an Agilent Poroshell 120 Phenyl Hexyl 2.1×50 mm, 1.9 µm analytical column with the following gradient (Mobile Phase A: LC-MS grade water with 0.1% formic acid; Mobile Phase B: LC-MS grade acetonitrile with 0.1% formic acid):

| Time (minutes) | % B |
| --- | --- |
| 0 | 40 |
| 0.1 | 40 |
| 0.6 | 60 |
| 1 | 65 |
| 1.01 | 95 |
| 2.01 | 95 |
| 2.02 | 40 |
| 2.5 | 40 |

The mass spectrometer was operated in negative ion multiple reaction monitoring mode. Each cannabinoid, cannabinoid precursor, cannabinoid derivative, or cannabinoid precursor derivative was identified by retention time, determined from an authentic standard, and multiple reaction monitoring (MRM) transition:

| Compound Name | Q1 Mass (Da) | Q3 Mass (Da) |
| --- | --- | --- |
| CBGA | 359.2 | 341.1 |
| CBGA | 359.2 | 315.2 |
| CBDA | 357.2 | 339.1 |
| CBDA | 357.2 | 245.1 |
| THCA | 357.0 | 313.0 |

Recovery and Purifications

Whole-cell broth from cultures comprising genetically modified host cells of the disclosure are extracted with a suitable organic solvent to afford cannabinoids, cannabinoid precursors, cannabinoid derivatives, or cannabinoid precursor derivatives. Suitable organic solvents include, but are not limited to, hexane, heptane, ethyl acetate, petroleum ether, and di-ethyl ether, chloroform, and ethyl acetate. The suitable organic solvent, such as hexane, is added to the whole-cell broth from fermentations comprising genetically modified host cells of the disclosure at a 10:1 ratio (10 parts whole-cell broth-1 part organic solvent) and stirred for 30 minutes. The organic fraction is separated and extracted twice with an equal volume of acidic water (pH 2.5). The organic layer is then separated and dried in a concentrator (rotary evaporator or thin film evaporator under reduced pressure) to obtain crude cannabinoid, cannabinoid precursor, cannabinoid derivative, or cannabinoid precursor derivative crystals. The crude crystals may then be heated to 105° C. for 15 minutes followed by 145° C. for 55 minutes to decarboxylate a crude cannabinoid or cannabinoid derivative. The crude crystalline product is re-dissolved and recrystallized in a suitable solvent (e.g., n-pentane) and filtered through a 1 µm filter to remove any insoluble material. The solvent is then removed e.g. by rotary evaporation, to produce pure crystalline product.

In Vitro Enzyme Assay and Cell-Free Production of Cannabinoids or Cannabinoid Derivatives In some embodiments, genetically modified host cells, e.g., genetically modified yeast cells, verified to comprise one or more heterologous nucleic acids encoding a GOT polypeptide that catalyzes production of cannabigerolic acid from geranyl pyrophosphate and olivetolic acid in an amount at least ten times higher than a polypeptide comprising an amino acid sequence set forth in SEQ ID NO:82 or a polypeptide comprising an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:100 or SEQ ID NO:110, are cultured in 96-well microtiter plates containing 360 µL of YPD (10 g/L yeast extract, 20 g/L Bacto peptone, 20 g/L dextrose (glucose)) and sealed with a breathable film seal. Cells are then cultured at 30° C. in a high capacity microtiter plate incubator shaking at 1000 rpm and 80% humidity for 3 days until the cultures reach carbon exhaustion. The growth-saturated cultures are then subcultured into 200 mL of YPGAL media to an OD600 of 0.2 and incubated with shaking for 20 hours at 30° C. Cells are then harvested by centrifugation at 3000×g for 5 minutes at 4° C. Harvested cells are then resuspended in 50 mL buffer (50 mM Tris-HCl, 1 mM EDTA, 0.1 M KCl, pH 7.4, 125 units Benzonase) and then lysed (Emulsiflex C3, Avestin, INC., 60 bar, 10 min). Cells debris is removed by centrifugation (10,000×g, 10 min, 4° C.). Subsequently, the supernatant is then subjected to ultracentrifugation (150,000×g, 1 h, 4° C., Beckman Coulter L-90K, TI-70). The resulting membrane fractions of the GOT polypeptide that catalyzes production of cannabigerolic acid from geranyl pyrophosphate and olivetolic acid in an amount at least ten times higher than a polypeptide comprising an amino acid sequence set forth in SEQ ID NO:82 or the polypeptide comprising an amino acid sequence having at least 65% (e.g., at least 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.6%, 99.7%, 99.8%, 99.9%, or 100%) sequence identity to SEQ ID NO:100 or SEQ ID NO:110 are then resuspended in 3.3 mL buffer (10 mM Tris-HCl, 10 mM $MgCl_2$, pH 8.0, 10% glycerol) and solubilized with a tissue grinder. Then, 0.02% (v/v) of the respective membrane preparations are then dissolved in reaction buffer (50 mM Tris-HCl, 10 mM $MgCl_2$, pH 8.5) and substrate (500 µM olivetolic acid, 500 µM GPP) to a total volume of 50 µL and incubated for 1 hour at 30° C. Assays are then extracted by adding two reaction volumes of ethyl acetate followed by vortexing and centrifugation. The organic layer is evaporated for 30 minutes, resuspended in acetonitrile/$H_2O$/formic acid (80:20:0.05%) and filtered with Ultrafree®-MC columns (0.22 µm pore size, PVDF membrane material). Cannabinoids or cannabinoid derivatives are then detected via LC-MS and/or recovered and purified.

Yeast Cultivation in a Bioreactor

Single yeast colonies comprising genetically modified host cells disclosed herein are grown in 15 mL of Verduyn medium (originally described by Verduyn et al, Yeast 8(7): 501-17) with 50 mM succinate (pH 5.0) and 2% glucose in a 125 mL flask at 30° C., with shaking at 200 rpm to an OD600 between 4 to 9. Glycerol is then added to the culture to a concentration of 20% and 1 mL vials of the genetically modified host cell suspension are stored at −80° C. One to two vials of genetically modified host cells are thawed and grown in Verduyn medium with 50 mM succinate (pH 5.0) and 4% sucrose for 24 hours, then sub-cultured to an OD600 reading of 0.1 in the same media. After 24 hours of growth at 30° C. with shaking, 65 mL of culture is used to inoculate a 1.3-liter fermenter (Eppendorf DASGIP Bioreactor) with 585 mL of Verduyn fermentation media containing 20 g/L galactose supplemented with hexanoic acid (2 mM), a carboxylic acid other than hexanoic acid (2 mM), olivetolic acid (1 mM), or an olivetolic acid derivative (1 mM). A poly-alpha-olefin may be added to the fermenter as an extractive agent. The fermenter is maintained at 30° C. and pH 5.0 with addition of $NH_4OH$. In an initial batch phase, the fermenter is aerated at 0.5 volume per volume per minute air (VVM) and agitation ramped to maintain 30% dissolved oxygen. After the initial sugar is consumed, the rise in dissolved oxygen triggers feeding of galactose+hexanoic acid (800 g galactose per liter+9.28 g hexanoic acid per liter) at 10 g galactose per liter per hour in pulses of 10 g galactose per liter doses (alternatively, rather than feeding the genetically modified host cells disclosed herein hexanoic acid, olivetolic acid, an olivetolic acid derivative, or a carboxylic acid other than hexanoic acid is fed to the genetically modified host cells).

Between pulses, the feed rate is lowered to 5 g galactose per liter per hour. Upon a 10% rise in dissolved oxygen, the feed rate is resumed at 10 g $L^{-1}$ hour$^{-1}$. As genetically modified host cell density increases, dissolved oxygen is allowed to reach 0%, and the pulse dose is increased to 50 g galacose per liter. Oxygen transfer rate is maintained at rates representative of full-scale conditions of 100 mM per liter per hour by adjusting agitation as volume increased. Feed rate is adjusted dynamically to meet demand using an algorithm that alternates between a high feed rate and low feed rate. During the low feed rate, genetically modified host cells should consume galactose and hexanoic acid, or, alternatively, olivetolic acid, an olivetolic acid derivative, or a carboxylic acid other than hexanoic acid, and any overflow metabolites accumulated during the high feed rate. A rise in dissolved oxygen triggers the high feed rate to resume. The length of time spent in the low feed rate reflects the extent to which genetically modified host cells are over- or underfed in the prior high feed rate pulse; this information is then monitored and used to tune the high feed rate up or down, keeping the low feed rate within a defined range.

Over time, the feed rate matches sugar and hexanoic acid, or, alternatively, olivetolic acid, an olivetolic acid derivative, or a carboxylic acid other than hexanoic acid, demand from genetically modified host cells. This algorithm ensures minimal net accumulation of fermentation products other than cannabinoids, cannabinoid derivatives, cannabinoid precursors, or cannabinoid precursor derivatives; biomass; and $CO_2$. In some embodiments, the process continues for 5 to 14 days. In certain such embodiments, accumulated broth is removed daily and assayed for biomass and cannabinoid, cannabinoid derivative, cannabinoid precursor, or cannabinoid precursor derivative concentration. A concentrated solution of $NH_4H_2PO_4$, trace metals and vitamins are added periodically to maintain steady state concentrations.

Example 1—Synthesis of Olivetolic Acid or Derivatives Thereof

The cannabinoid pathway is composed of four biosynthetic steps using the precursors hexanoyl-CoA, malonyl-CoA, and geranyl pyrophosphate (FIG. 1, Box 4). *Saccharomyces cerevisiae* has previously been engineered to produce high levels of malonyl-CoA. To increase geranyl pyrophosphate supply, the engineering strategy as outlined in FIG. 1, Box 3, was carried out. In addition, a heterologous nucleic acid encoding an ACC1 polypeptide was overexpressed to increase flux to malonyl-CoA.

FIG. 1: Diagram illustrating biosynthetic pathways for converting sugar or hexanoate to the cannabinoids $\Delta^9$-THC and CBD To date, engineering biosynthesis of the precursor hexanoyl-CoA in *Saccharomyces cerevisiae* has not been described. Strategies for hexanoyl-CoA biosynthesis in *Saccharomyces cerevisiae*, as outlined in FIG. 1, were conceived: Pathway 1a) hexanoyl-CoA synthetase polypeptide from *C. saliva* converts hexanoate to hexanoyl-CoA (FIG. 1, box 1a). A heterologous nucleic acid encoding a hexanoyl-CoA synthetase polypeptide from *C. sativa* was integrated into *S. cerevisiae*. The resulting cells were fed hexanoate to increase hexanoyl-CoA supply (FIG. 2).

Figure 2:
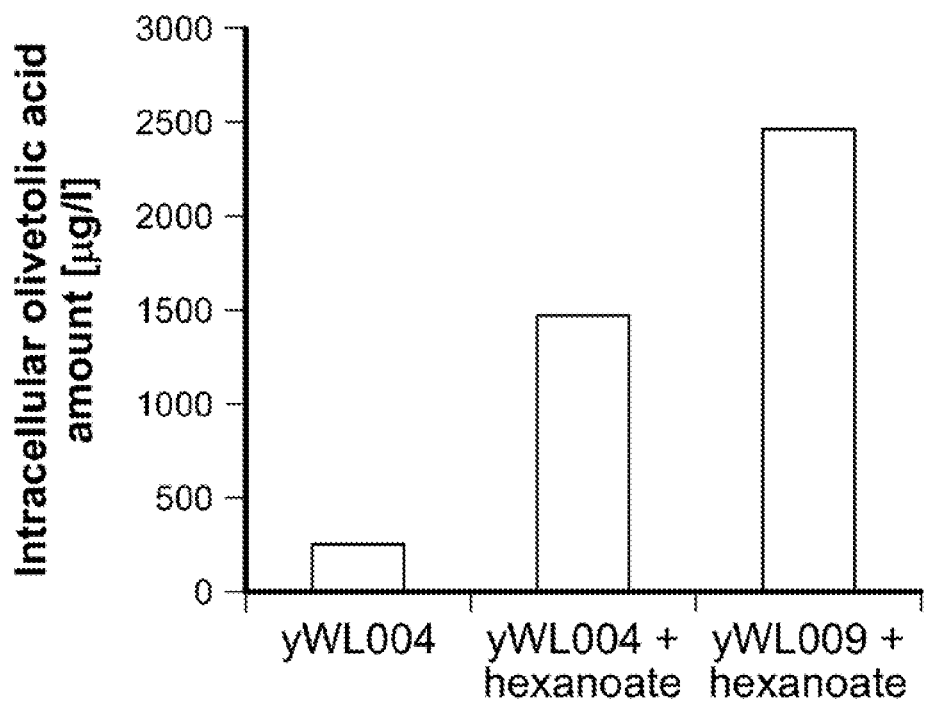
FIG. 2 depicts intracellular olivetolic acid production using pathway 1a and a tetraketide synthase (TKS) polypeptide/olivetolic acid cyclase (OAC) polypeptide.

FIG. 2: Intracellular olivetolic acid production using pathway 1a and TKS/OAC polypeptides. Yeast strains yWL004 expressing a heterologous nucleic acid encoding a TKS polypeptide and a heterologous nucleic acid encoding an OAC polypeptide and yWL009 expressing a heterologous nucleic acid encoding a TKS polypeptide, a heterologous nucleic acid encoding an OAC polypeptide, and a heterologous nucleic acid encoding a HCS polypeptide were grown in YPG and either in the absence or presence of 1 mM hexanoate for olivetolic acid production. Addition of hexanoate leads to six-fold increase in olivetolic acid production in strain yWL004, indicating an endogenous acyl-CoA ligase activity. Chromosomal integration of the heterologous nucleic acid encoding a hexanoyl-CoA synthetase polypeptide leading to strain yWL009 shows an additional two-fold increase in olivetolic acid production due to increased hexanoyl-CoA supply.

Biosynthesis of hexanoyl-CoA from fermentable sugars was increased by integrating pathway 1b, which comprises four enzymes encoding a reverse β-oxidation pathway that has been optimized in *E. coli* for production of hexanol (FIG. 1, box 1b) (Machado et al. 2012). LC-MS analysis confirmed that this pathway was also functional in *S. cerevisiae* and its activity is comparable to pathway 1a, since olivetolic acid yields were similar between the engineered strains yWL009 and yWL0013 (FIG. 3).

Figure 3:
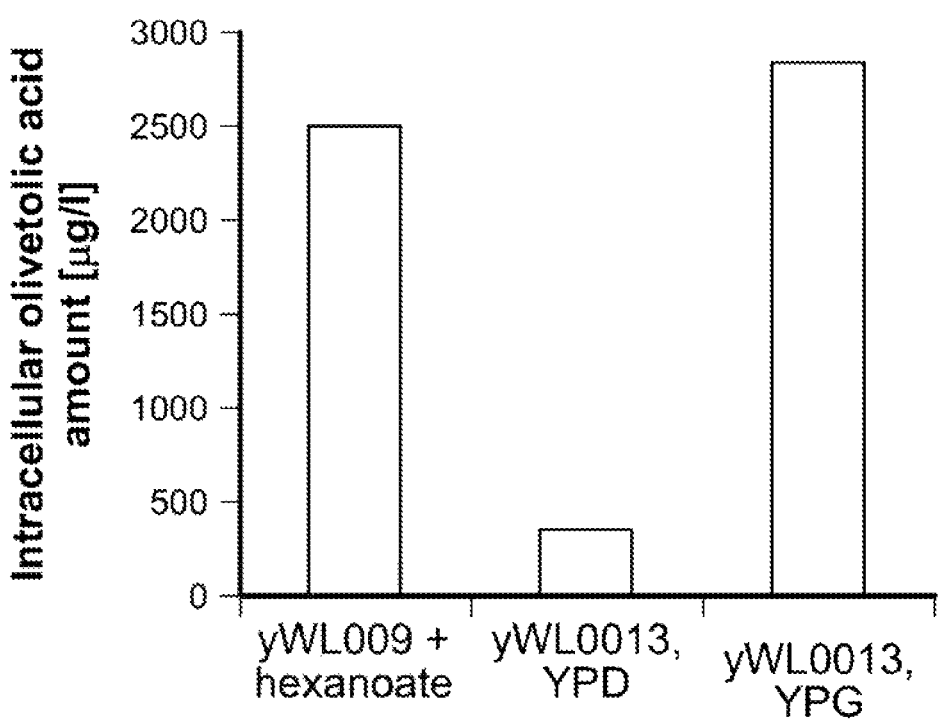
FIG. 3 depicts intracellular olivetolic acid production comparing pathway 1a and 1b.

FIG. 3: Intracellular olivetolic acid production comparing pathway 1a and 1b. Yeast strain yWL009 expressing a heterologous nucleic acid encoding a TKS polypeptide, a heterologous nucleic acid encoding an OAC polypeptide, and a heterologous nucleic acid encoding a HCS polypeptide was grown in producing conditions (YPG with 1 mM hexanoate) and compared to yWL013 expressing a heterologous nucleic acid encoding a TKS polypeptide, a heterologous nucleic acid encoding a OAC polypeptide, and the hexanoyl-CoA supply pathway 1b grown in non-producing (YPD) as well as producing (YPG) conditions. Chromosomal integration of the hexanoyl-CoA pathway yields similar levels in olivetolic acid production as strain yWL009 when grown in YPG with 1 mM hexanoate.

TABLE 2

List of strains used in this study

| | |
|---|---|
| yWL004 | Cen.PK2, ACC1::TKS-OAC, tHMGR::MvaE/S, |
| yWL009 | Cen.PK2, ACC1::TKS-OAC, tHMGR::MvaE/S, URA3::HCS |
| yWL0013 | CenPK2, ACC1::TKS-OAC, URA3::HexCoA |

Codon optimized genes were synthesized and used in this study for the polypeptides listed in Table 3.

TABLE 3

List of polypeptides used in this study

| Polypeptide | Function | Original host |
|---|---|---|
| BktB | β-ketothiolase | *Ralstonia eutropha* |
| PaaH1 | 3-Hydroxyacyl-CoA dehydrogenase | *R. eutropha* |
| Crt | Crotonase | *Clostridium acetobutylicum* |
| Ter | Trans-2-enoyl-CoA reductase | *Treponema denticola* |
| HCS | Hexanoyl-CoA synthetase | *Cannabis sativa* |
| ERG10 | Acetyl-CoA acetyltransferase | *Saccharomyces cerevisiae* |
| ERG13 | HMG-CoA synthase | *S. cerevisiae* |
| tHMG1 | HMG-CoA reductase | *S. cerevisiae* |
| ERG12 | Mevalonate kinase | *S. cerevisiae* |
| IDI1 | Isopentenyl diphosphate:dimethylallyl diphosphate isomerase | *S. cerevisiae* |
| ERG20 | Farnesylpyrophosphate synthetase | *S. cerevisiae* |
| MvaE | acetyl-CoA acetyltransferase/HMG-CoA reductase | *Escherichia coli* |
| MvaS | HMG-CoA synthase | *E. coli* |
| TKS | Tetraketide Synthase (Type III PKS) | *C. sativa* |
| OAC | Olivetolic acid cyclase | *C. sativa* |
| GOT | geranyl pyrophosphate:olivetolate geranyltransferase | *C. sativa* |
| Δ⁹-THCAS | $\Delta^9$-tetrahyrdocannabinoidic acid synthase | *C. sativa* |
| CBDAS | cannabidiolic acid synthase | *C. sativa* |
| DXS | 1-deoxy-D-xylulose-5-phosphate synthase gene | *E. coli* |
| IspC | 1-deoxy-D-xylulose 5-phosphate reductoisomerase | *E. coli* |
| IspD | 2-C-methyl-D-erythritol 4-phosphate cytidylyltransferase | *E. coli* |
| IspE | 4-diphosphocytidyl-2-C-methylerythritol kinase | *E. coli* |
| IspF | 2C-methyl-D-erythritol 2,4-cyclodiphosphate synthase | *E. coli* |
| IspG | 4-hydroxy-3-methylbut-2-en-1-yl diphosphate synthase | *E. coli* |
| IspH | 4-hydroxy-3-methylbut-2-enyl diphosphate reductase | *E. coli* |
| IDI | Isopentenyl diphosphate (IPP) isomerase | *E. coli* |
| IspA* | mutated FPP synthase (S81F) for GPP production | *E. coli* |
| AflA | Hexanoyl-CoA synthase, subunit A | *Aspergillus parasiticus* |
| AflB | Hexanoyl-CoA synthase, subunit B | *A. parasiticus* |
| SCFA-TE | Short chain fatty acyl-CoA Thioesterase | Various microbes |

Example 2—Synthesis of Olivetolic Acid or Derivatives Thereof or Cannabinoids or Derivatives Thereof Multiple polypeptides in pathway 1b require NADH as a co-factor. In order to maximize flux through pathway 1b, other biosynthetic pathways that compete for NADH supply are modified (FIG. 1, Box 2). One target can be the ethanol pathway, mediated by various alcohol dehydrogenase polypeptides, but may also include other pathways that consume NADH, such as the glycerol biosynthesis pathway.

Another route conceived towards hexanoyl-CoA is described in pathway 1c: The alfatoxin biosynthetic gene cluster (iterative type I PKS) encodes a fatty acid synthase-based mechanism (FasA and FasB) for production of hexanoyl-CoA. In some embodiments, a heterologous nucleic acid encoding a thioesterase polypeptide and a heterologous nucleic acid encoding a CoA ligase polypeptide similar to a C6-tolerant thioesterase polypeptide (see BMC Biochem. 2011 Aug. 10; 12:44. doi: 10.1186/1471-2091-12-44) and a heterologous nucleic acid encoding a HCS polypeptide are expressed to facilitate release of hexanoyl-ACP and activate free hexanoate to its acyl-CoA compound. Additionally, various type II PKS biosynthetic pathways (e.g. benastatin, R1128) contain a FabH-like KSIII (e.g. BenQ, ZhuH), AT and ACP component, which are crucial for providing and selecting the rare hexanoate PKS starter unit. Lastly, the type I PKS pathway for reveromycin biosynthesis encodes the fatty acyl-CoA ligase RevS polypeptide and the FabH-like KASIII component RevR polypeptide, which are suggested to provide hexanoyl-CoA via fatty acid degradation as well as de novo fatty acid biosynthesis.

To avoid competitive consumption of hexanoyl-CoA via β-oxidation, the fatty acid degradation pathway is engineered to have lowered activity. Alternatively, yeast are grown in presence of oleic acid to avoid competition for fatty acids as energy source.

Figure 4:
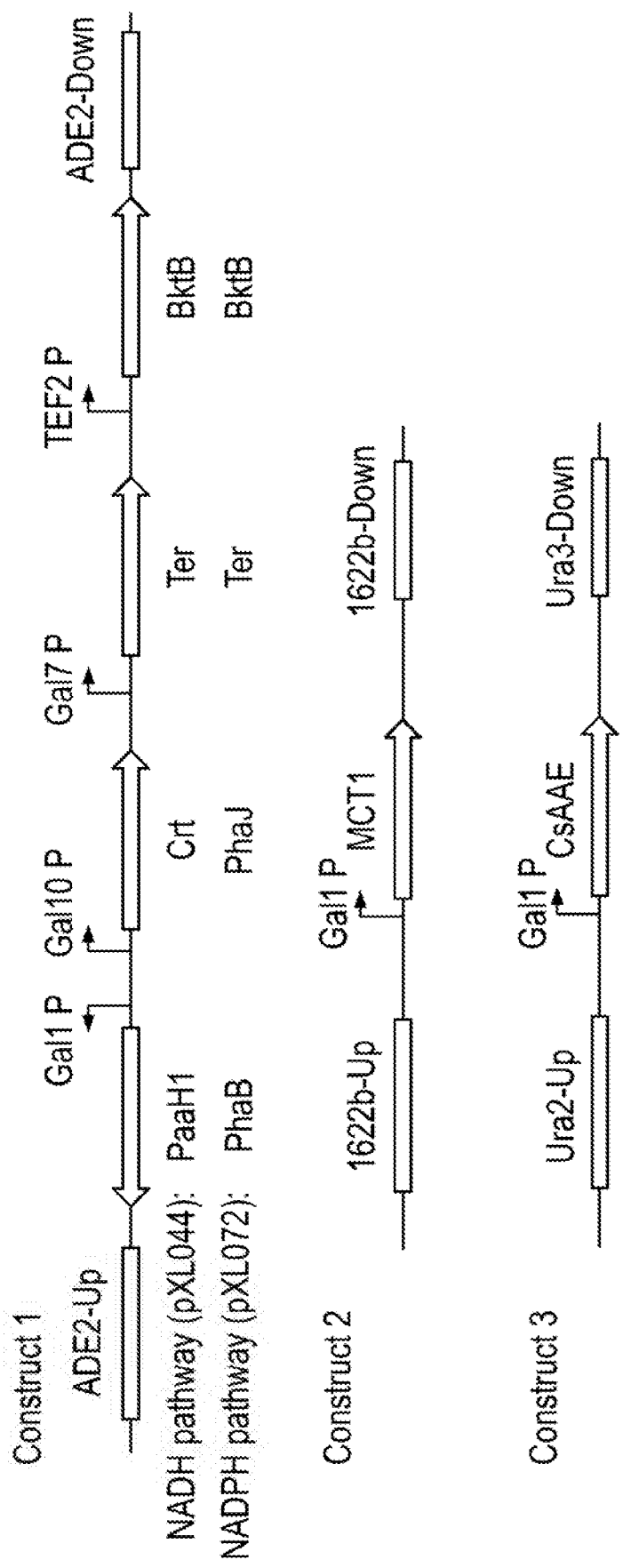
FIG. 4 provides schematic depictions of 3 expression constructs for olivetolic acid production.

The pathway of four genes encoding the NADH pathway for hexanoyl-CoA production, including polypeptides PaaH1, Crt, Ter, and BktB, was constructed under the control of Gal1, Gal10, Gal7, and TEF2 promoters, respectively. FIG. 4. The whole cassette was inserted between the upstream and downstream homology region of ADE2 and was integrated into the genome of S. cerevisiae using CRISPR/Cas9 to generate yXL001 (using Construct 1/pXL044 as shown in FIG. 4). The pathway of four genes encoding the NADPH pathway (including PhaB, PhaJ, Ter, and BktB polypeptides) was introduced into to S. cerevisiae in the same way to generate yXL002 (using Construct 1/pXL072 as shown in FIG. 4). The MCT1 gene under the control of Gal1 promoter flanked by the 1622b homology region (Construct 2; FIG. 4) was introduced into the genome of yXL001 and yXL002 using CRISPR/Cas9 to generate yXL003 and yXL004 (FIG. 4).

Figure 5:
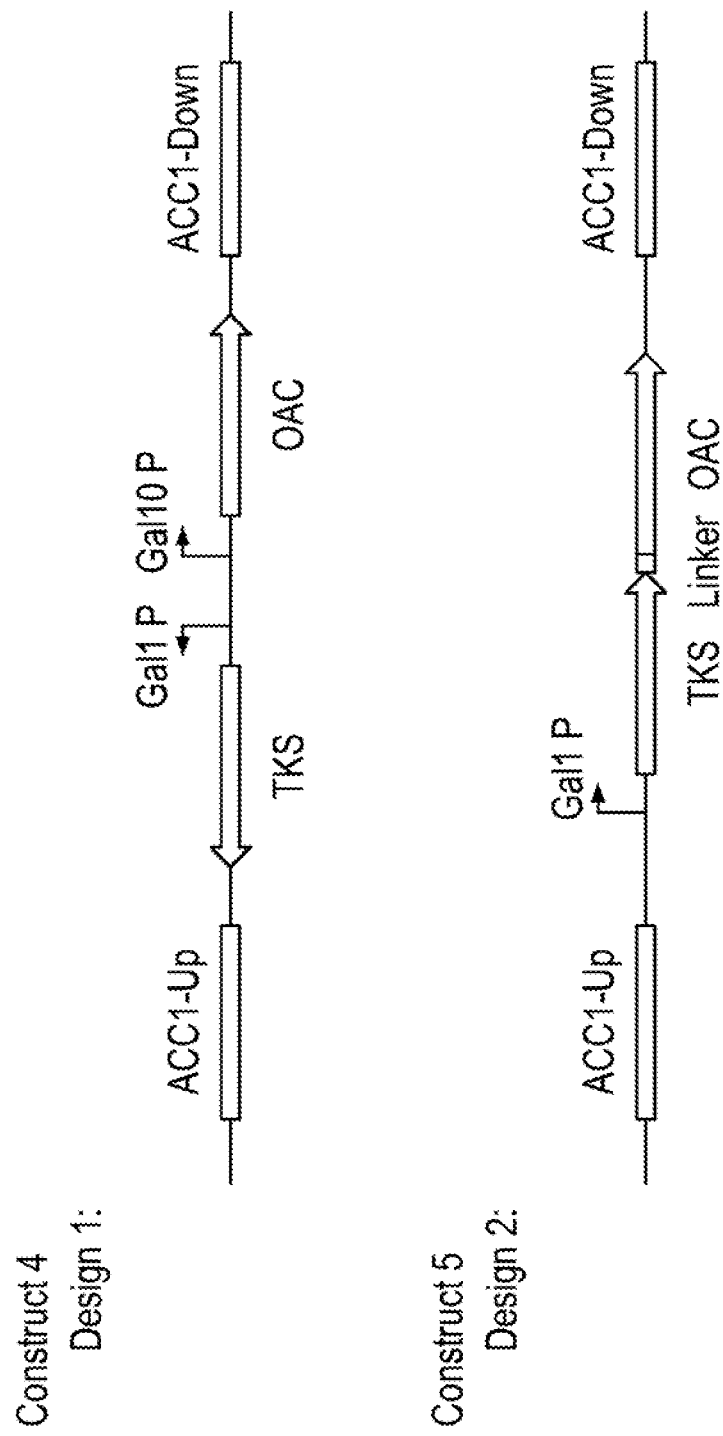
FIG. 5 provides schematic depictions of 2 expression constructs for olivetolic acid production.
Figure 9:
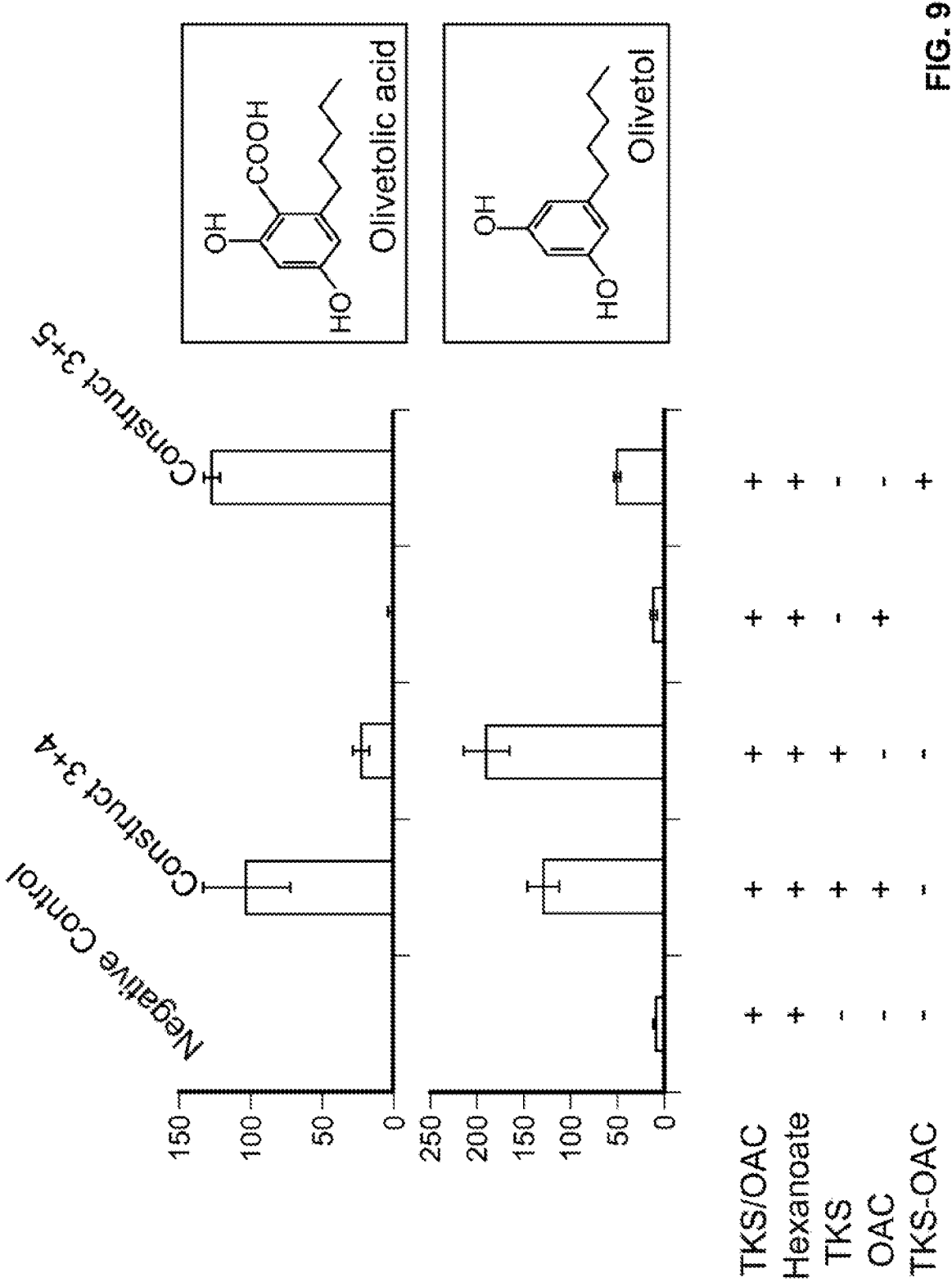
FIG. 9 depicts production of olivetolic acid using expression constructs 3+4 or expression constructs 3+5.
Figure 10:
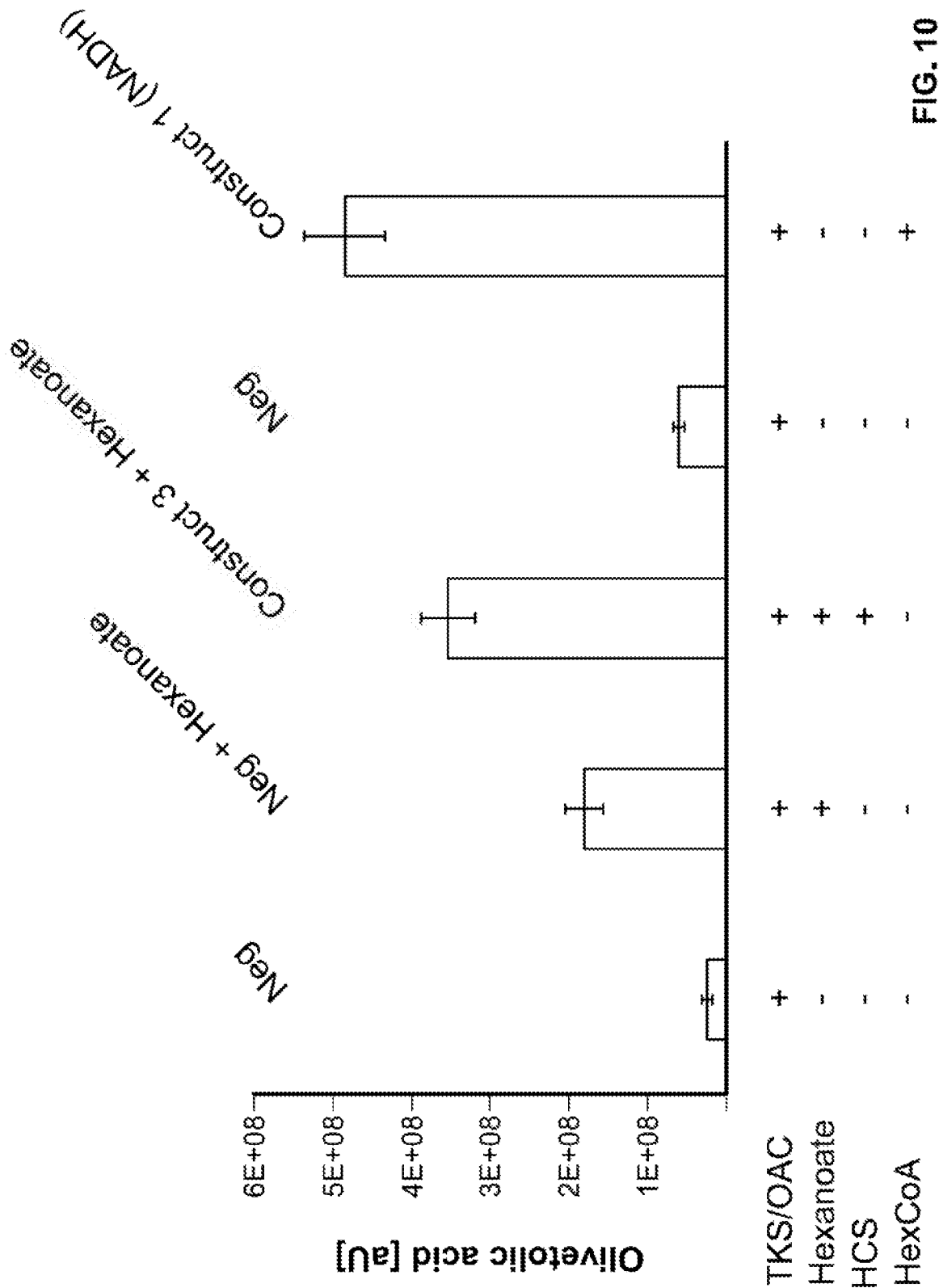
FIG. 10 depicts production of olivetolic acid using Construct 3 and culturing the cells in medium comprising hexanoate; or using Construct 1.

A cassette encoding TKS and OAC genes under the control of Gal1 and Gal10 promoters flanked by ACC1 homology region (Construct 4; FIG. 5) was introduced into the genome of yXL003 and yXL004 using CRISPR/Cas9 to generate yXL005 and yXL006. A heterologous nucleic acid encoding a TKS-OAC fusion polypeptide under the control of a Gal1 promoter (Construct 5; FIG. 5) was introduced into yXL003 and yXL004 to generate yXL007 and yXL008. The resulting strains were inoculated into 10 mL YP medium supplemented with 2% dextrose. After an overnight culture at 30° C. and centrifugation at 3,000×g for 5 mins, the pellet was resuspended into YP medium supplemented with 2% galactose. After two days expression, the culture supernatant was extracted with equal volume of ethyl acetate, and, after evaporation and filtration, the samples were analyzed by LC-MS, which showed the production of a significant amount of olivetolic acid (FIG. 9 and FIG. 10).

CsAAE (Construct 3; FIG. 4), TKS, and OAC genes (Construct 4; FIG. 5) were introduced into the genome of S. cerevisiae using CRISPR/Cas9 to generate yXL009, which can produce higher level of olivetolic acid in the presence of exogenously supplied hexanoate (FIG. 11).

Figure 12:
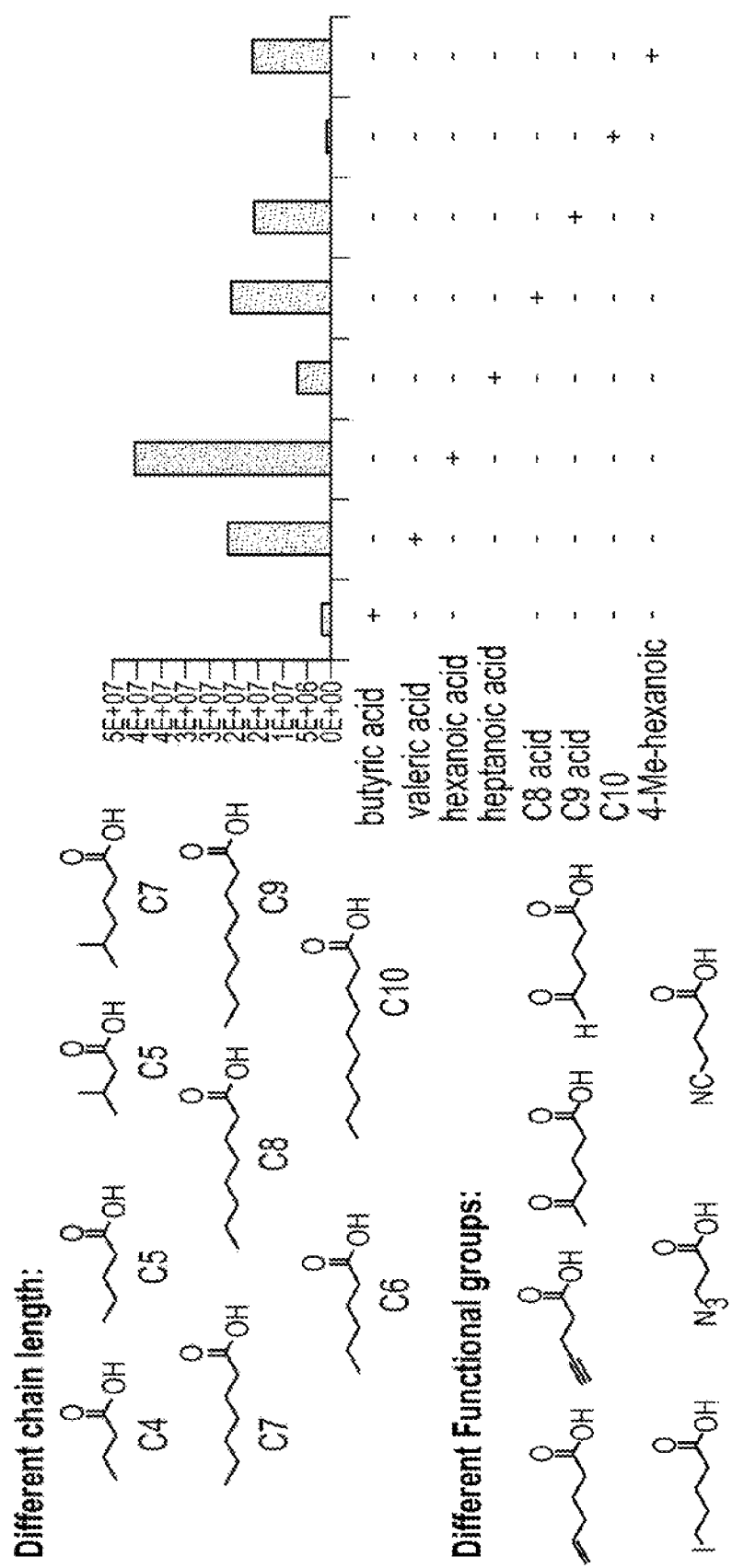
FIG. 12 depicts various representative carboxylic acids with various functional groups that can be used as substrate for the biosynthesis of olivetolic acid or cannabinoid derivatives.

In addition, by supplementing the growth medium with various aliphatic acids, from $C_4$-$C_{10}$, various olivetolic acid derivatives can be produced from yXL009 (FIG. 11 and FIG. 12). Some of the olivetolic acid derivatives can be further modified by biological or chemical means to covalently attach to other compounds. For example, click chemistry can be performed on the olivetolic derivative containing alkyne functional group. The olivetolic derivative is dissolved in biology grade dimethyl sulfoxide (DMSO) and treated with a DMSO solution of crosslinker containing an azide group (1.0 equiv.), TBTA (DMSO:tBuOH 1:1), $CuSO_4$ $5H_2O$, sodium ascorbate and HEPES-KOH pH: 7.0 (final HEPES-KOH≈250 mM). The reaction is placed on a water bath at 37° C. for 12 to 16 hours. Liquid chromatograph-mass spectrometry (LC-MS) analysis of the reaction mixture shows reaction completion after 16 hours to obtain the further modified olivetolic acid.

Figure 7:
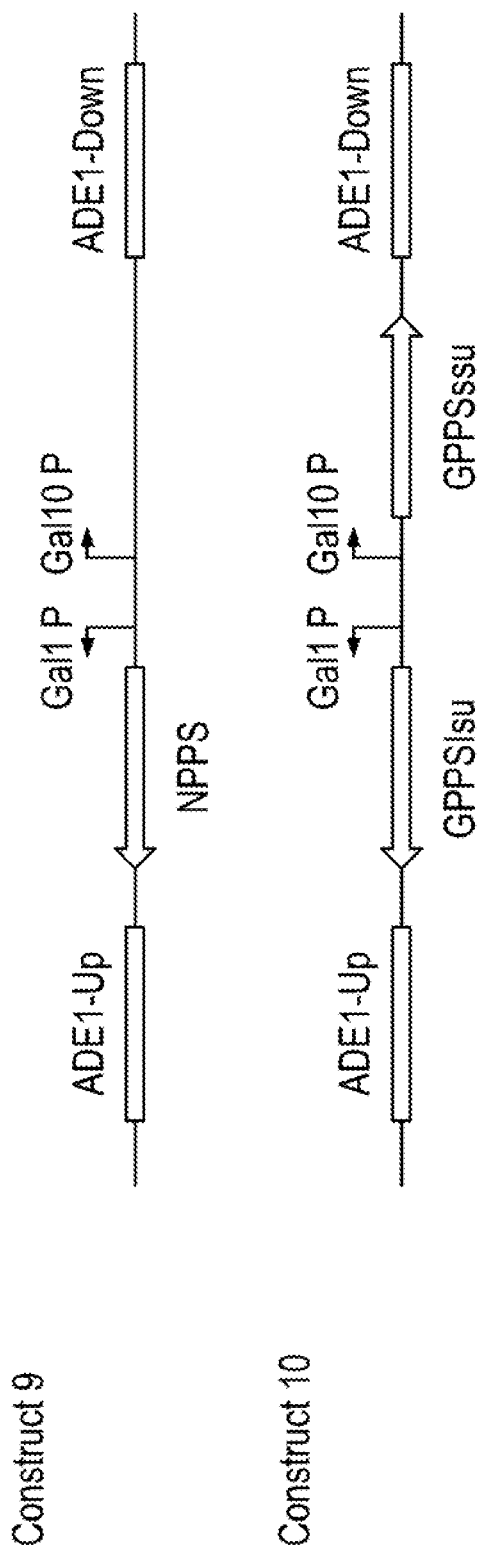
FIG. 7 provides schematic depictions of 2 expression constructs for GPP production.
Figure 8:
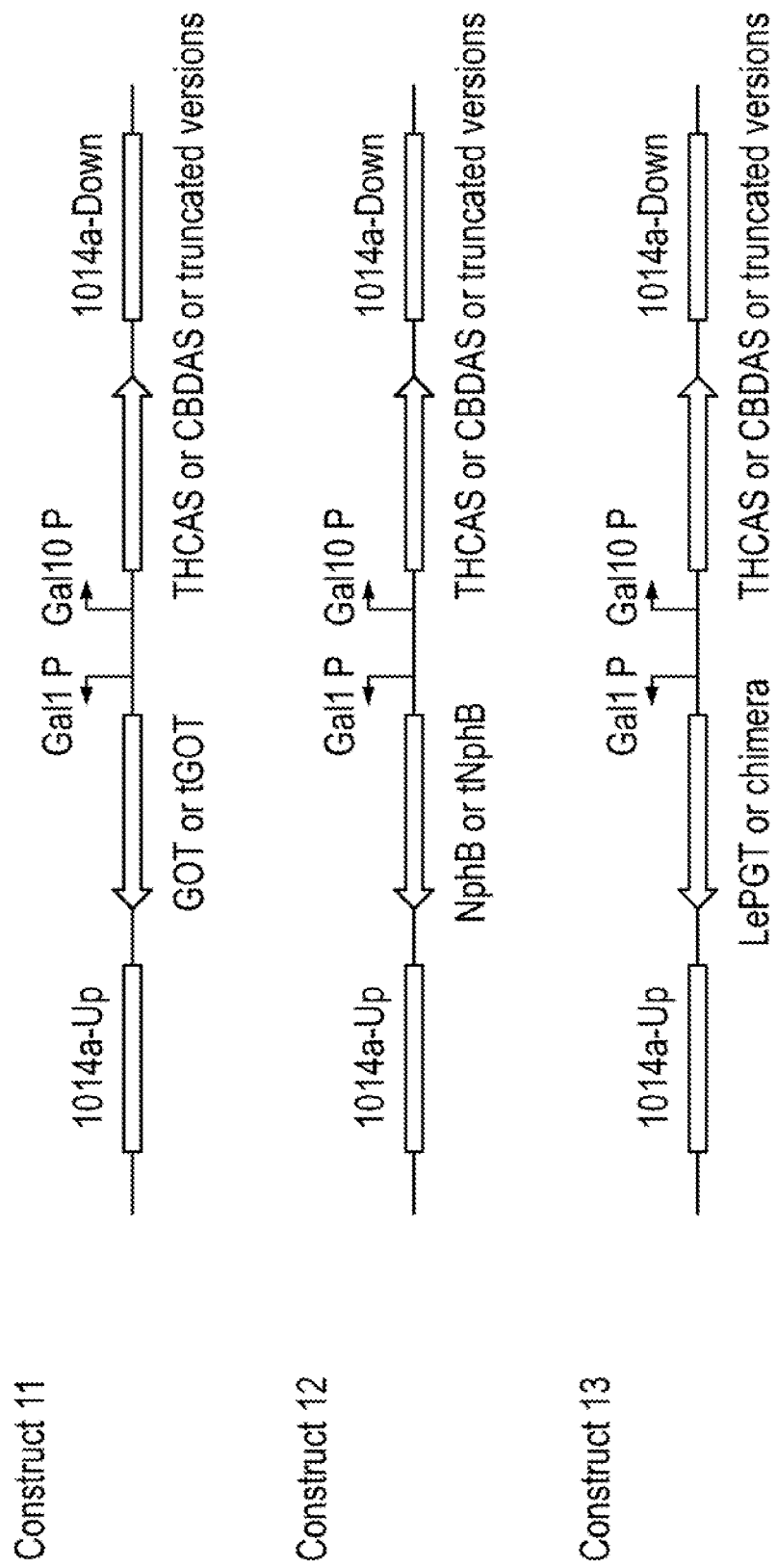
FIG. 8 provides schematic depictions of 3 expression constructs for cannabinoid production.
Figure 13:
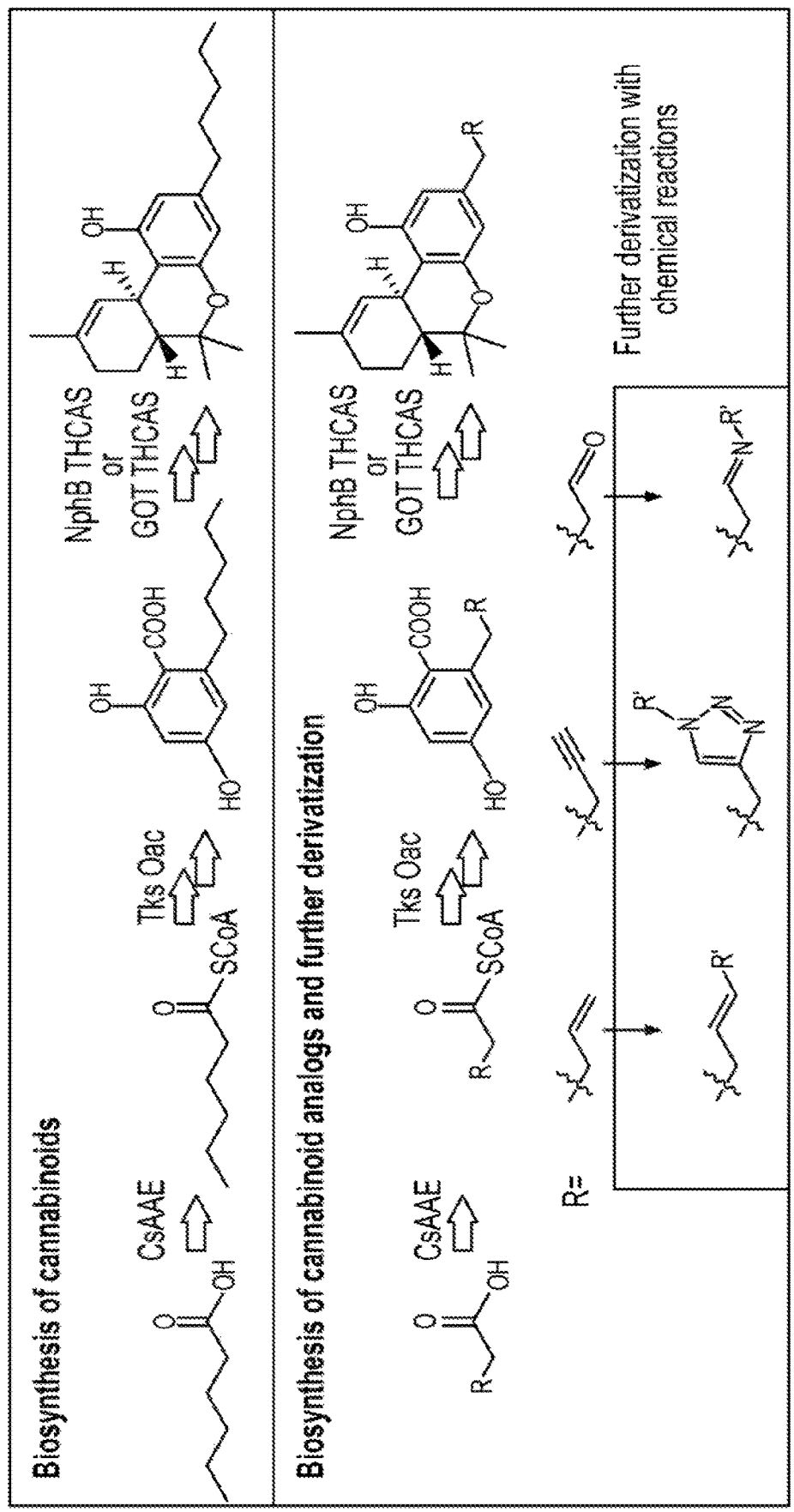
FIG. 13 depicts various representative cannabinoid derivatives that can be generated by feeding different acids and the further derivatization of those derivatives with chemical reactions.
Figure 14:
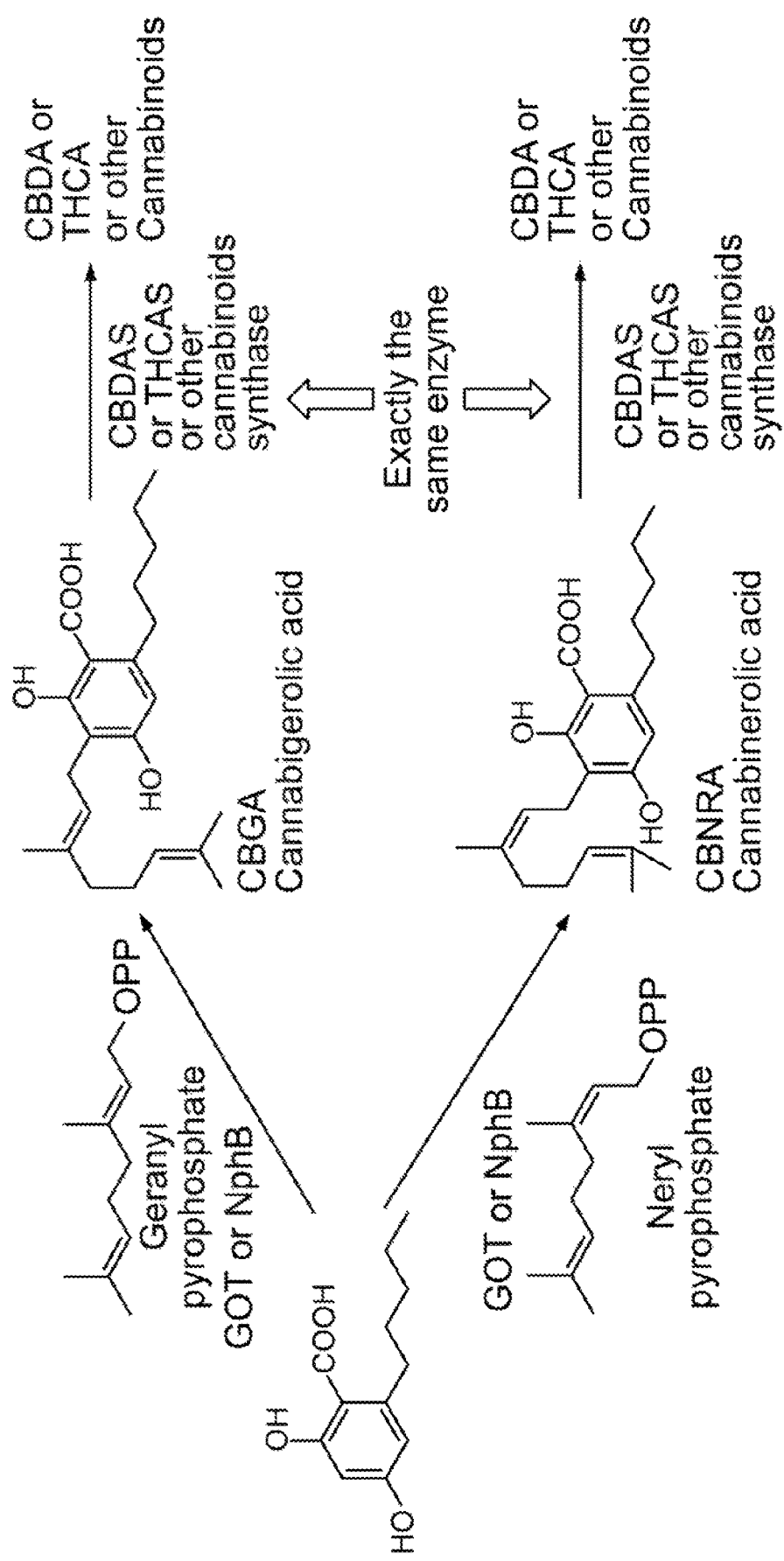
FIG. 14 depicts cannabinoid biosynthetic pathways utilizing neryl pyrophosphate (NPP) or GPP.
Figure 15:
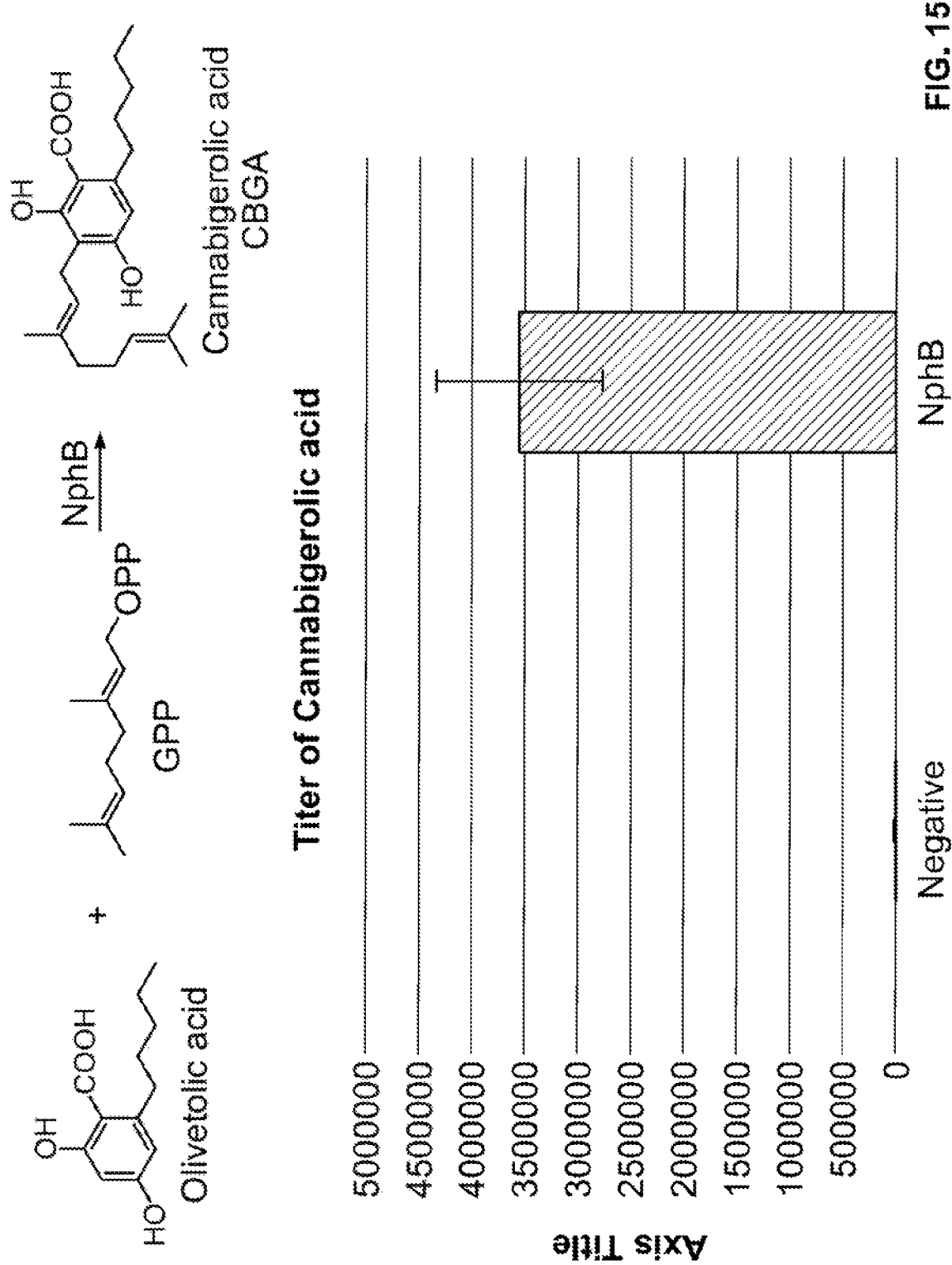
FIG. 15 depicts generation of cannabigerolic acid (CBGA) using a NphB polypeptide and the substrates olivetolic acid and GPP.

The GPPS large subunit (GPPSlsu) and small subunit (GPPSssu) genes from Cannabis saliva under the control of Gal1 and Gal10 promoters flanked by ADE1 homology region (Construct 10; FIG. 7) were introduced into yXL008 and yXL009 to generate yXL010 and yXL011. A cassette encoding a NphB polypeptide and a THCAS polypeptide under the control of Gal1 and Gal10 promoters flanked by 1014a homology region (Construct 12; FIG. 8) was introduced into the genome of yXL010 and yXL011 to generate yXL012 and yXL013 using CRISPR/Cas9. The resulting strains were inoculated into 10 mL YP medium supplemented with 2% dextrose. After an overnight culture at 30° C. and centrifugation at 3,000×g for 5 mins, the pellet was resuspended into YP medium supplemented with 2% galactose. After two days expression, the culture supernatant was extracted with equal volume of ethyl acetate, and, after evaporation and filtration, the samples were analyzed by LC-MS, which showed that the overexpression of NphB in yXL010 resulted in the production of cannabigerolic acid (FIGS. 14 and 15). In the presence of a THCAS polypeptide, the cannabigerolic acid was transformed into THCA or into THC. With yXL013, $C_4$-$C_{10}$ acids were added to the expression medium, resulting in the production of cannabigerolic acid derivatives, which were then modified by a THCAS polypeptide to produce THCA or THC derivatives. Those derivatives can then be further modified by chemical reactions (FIG. 13).

Example 3—Synthesis of Cannabinoid Precursors, Cannabinoids, or Derivatives of the Foregoing To recreate cannabinoid production in microorganisms, chassis S. cerevisiae strains were developed containing metabolic pathways for the production of (1) GPP through the mevalonate (Mva) pathway, (2), olivetolic acid or derivatives, (3) CBGA or derivatives, and (4) different cannabinoids or cannabinoid derivatives produced by cannabinoid synthase polypeptides.

Production of GPP

Figure 16:
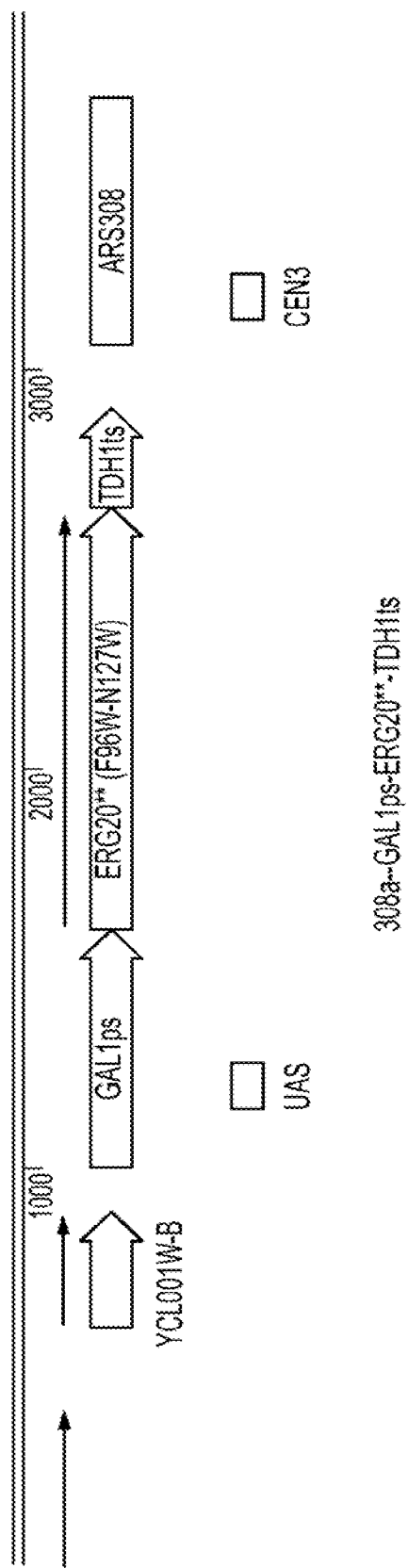
FIG. 16 depicts an expression construct to produce GPP.
Figure 17:
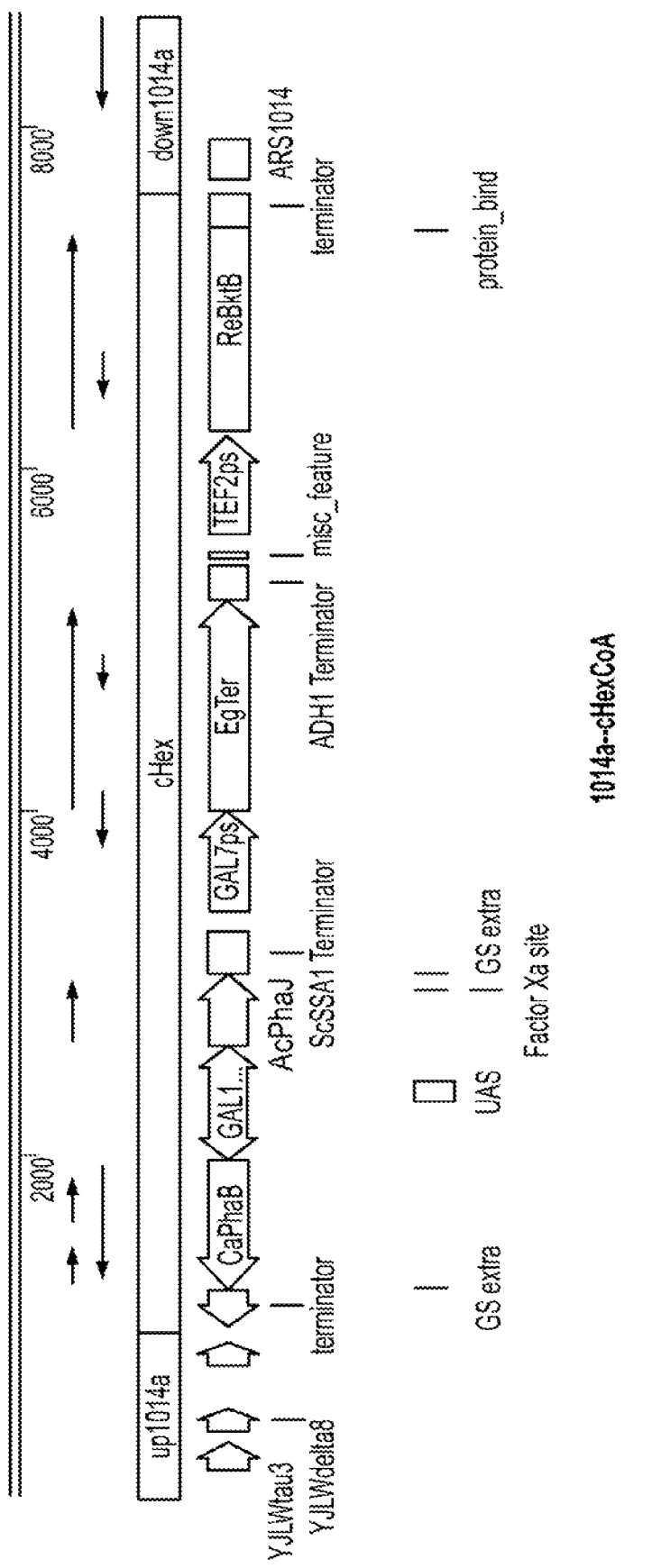
FIG. 17 depicts an expression construct to produce hexanoyl-CoA and/or hexanoate.
Figure 18:
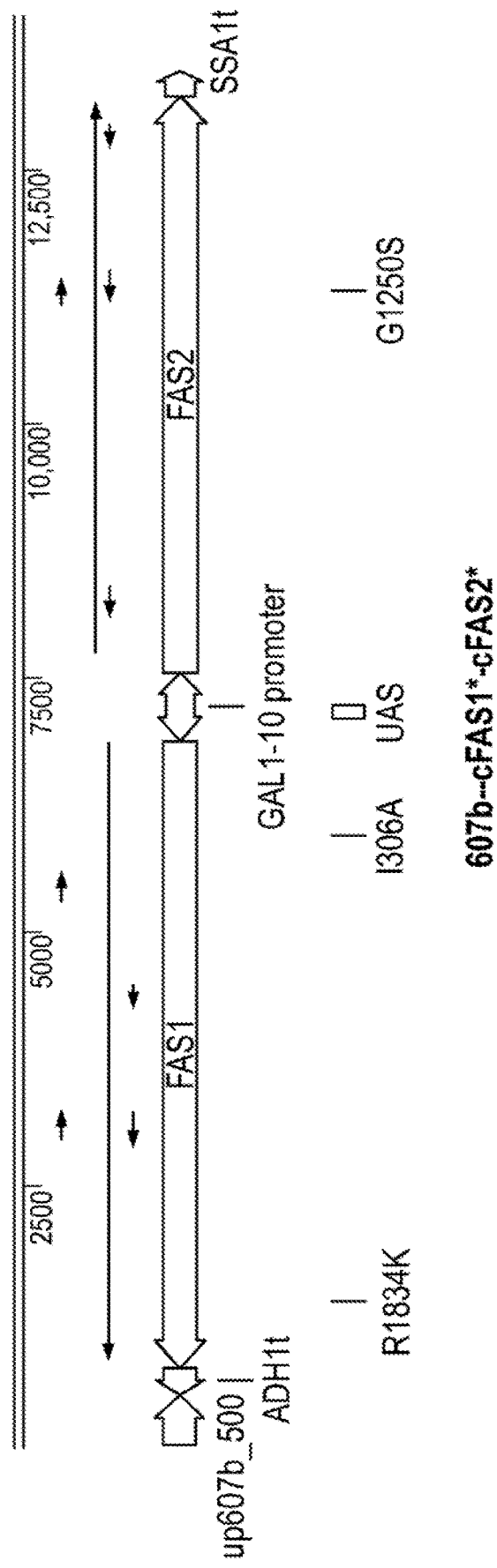
FIG. 18 depicts an expression construct to produce hexanoyl-CoA and/or hexanoate.
Figure 19:
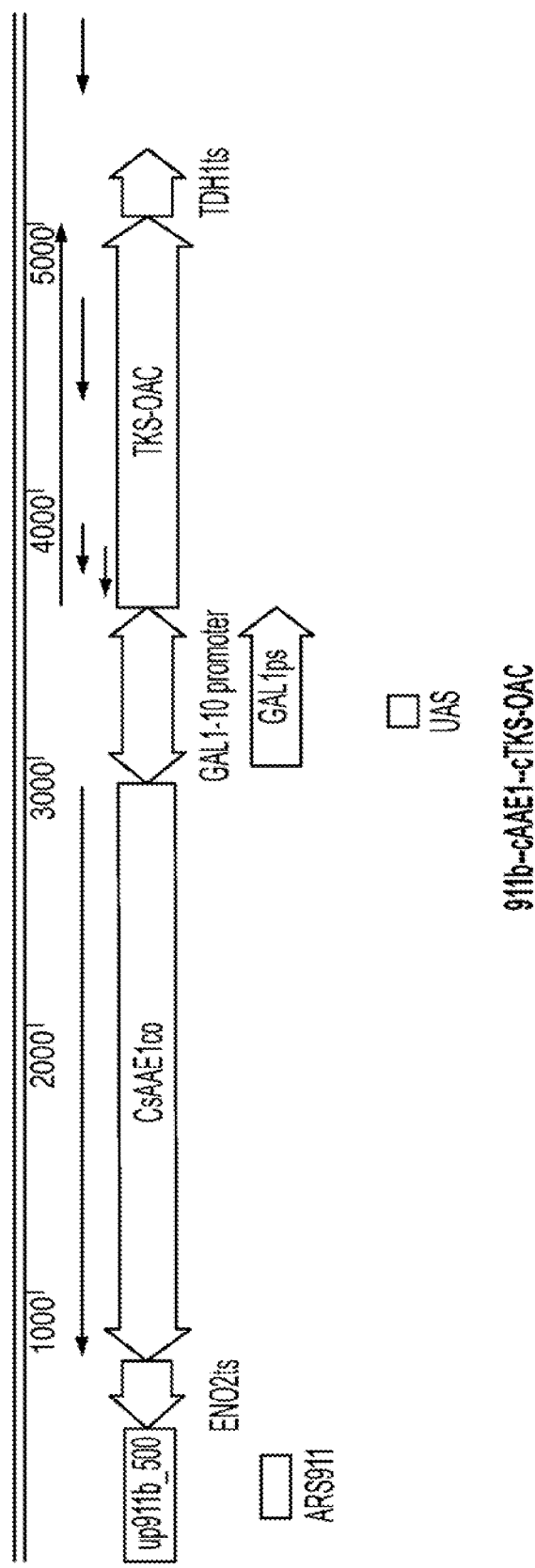
FIG. 19 depicts an expression construct to produce olivetolic acid.

A GPP-overproducing strain, GTY23, was produced by overexpressing Mva pathway genes and introducing a repressible promoter on ERG9. A previously described ERG20 F96W-N127W mutant, ERG20mut, was added to provide a source of GPP precursor in the cell (FIG. 16). This strain was used to screen GOT polypeptide candidates.

Production of Olivetolic Acid or Derivatives Thereof

Olivetolic acid was produced from sugar by introducing genes CsTKS and CsOAC, and pathways to produce hexanoyl-CoA. Pathways for the production of hexanoate and hexanoyl-CoA are known in the art (e.g., Gajewski et al, "Engineering fungal de novo fatty acid synthesis for short chain fatty acid production," Nature Communications 2017). To produce olivetolic acid or its derivatives, rather than using hexanoyl-CoA pathways, a previously reported acyl-CoA ligase polypeptide, such as a CsAAE1 or CsAAE3 polypeptide, was introduced and exogenously fed cells hexanoate or a carboxylic acid other than hexanoate (FIGS.

17-19). These pathways allow for the production of non-naturally occurring cannabinoids.

Production of CBGA

Figure 6:
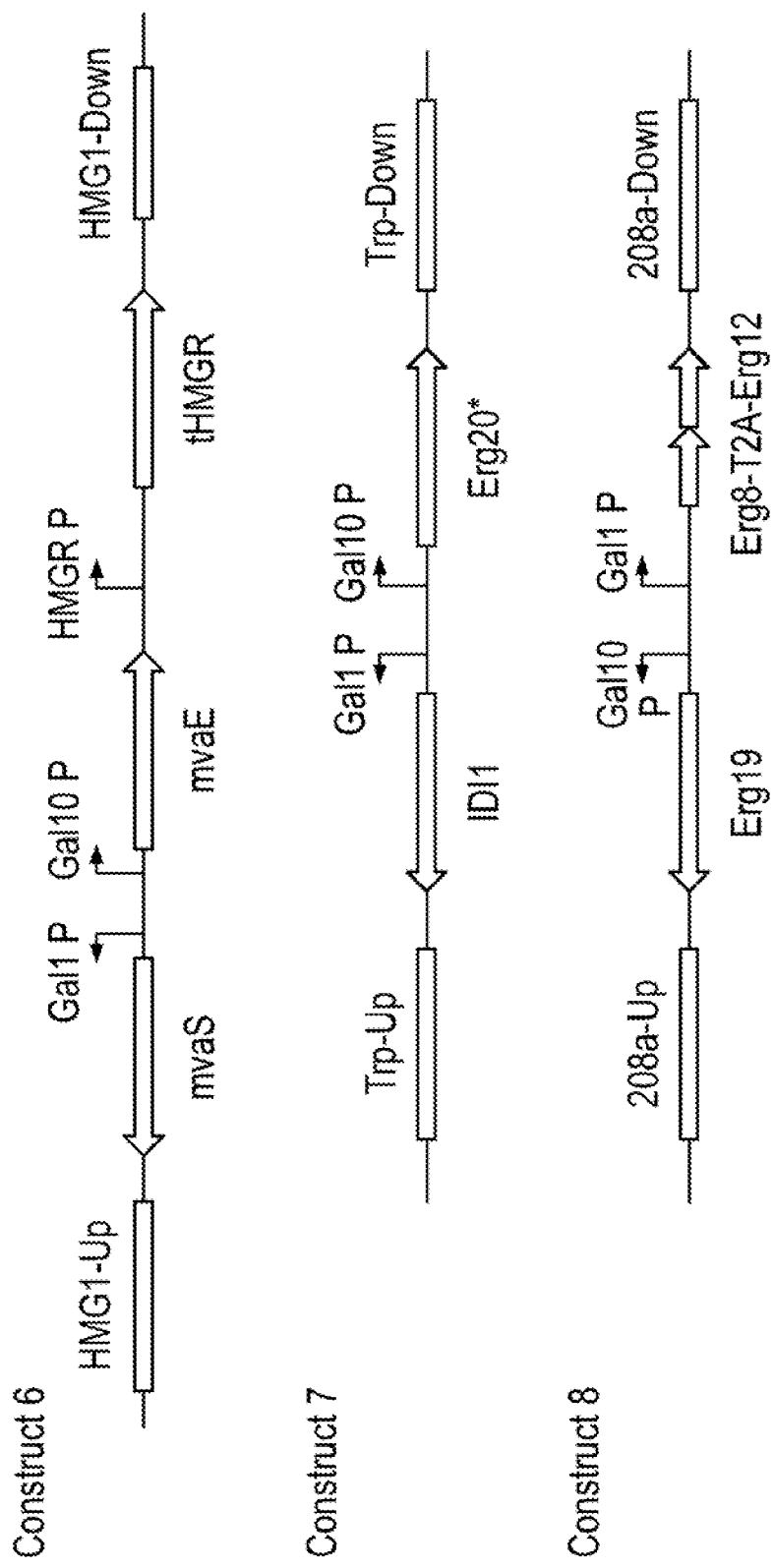
FIG. 6 provides schematic depictions of 3 expression constructs for geranyl pyrophosphate (GPP) production.
Figure 20:
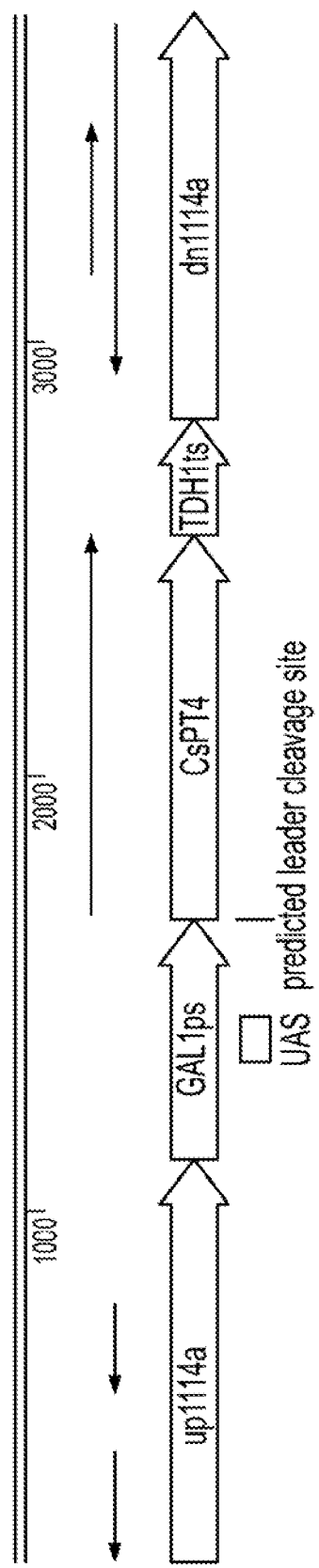
FIG. 20 depicts an expression construct to produce CBGA.
Figure 21:
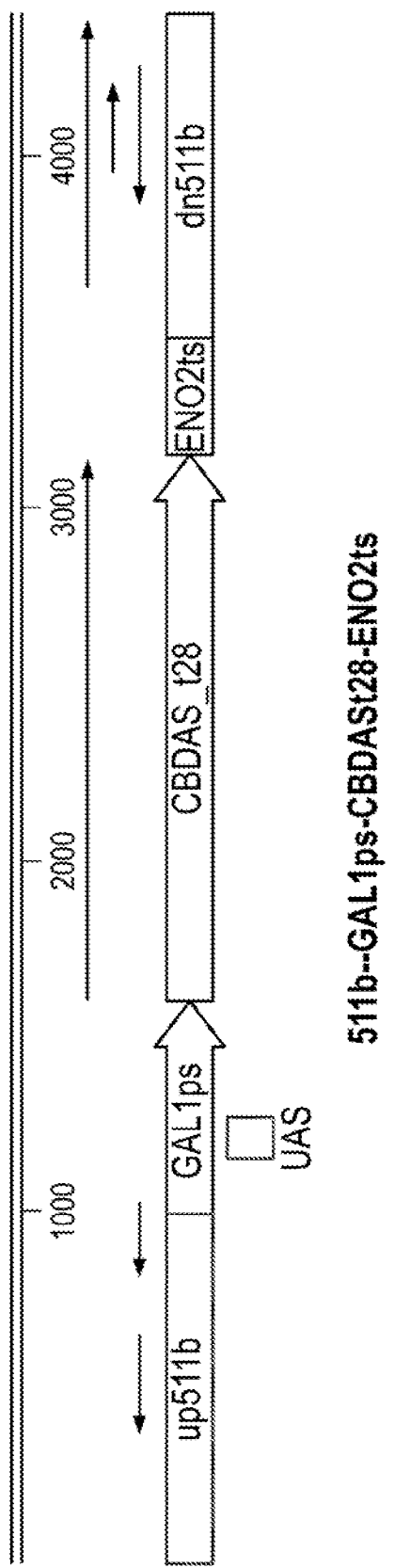
FIG. 21 depicts an expression construct to produce cannabidiolic acid (CBDA).
Figure 22:
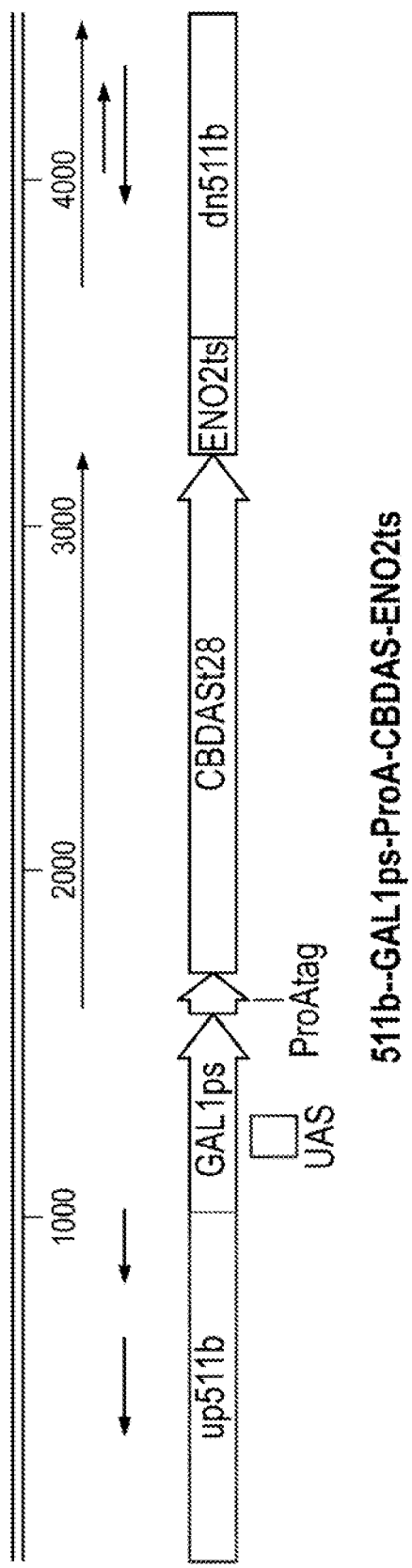
FIG. 22 depicts an expression construct to produce CBDA.
Figure 23:
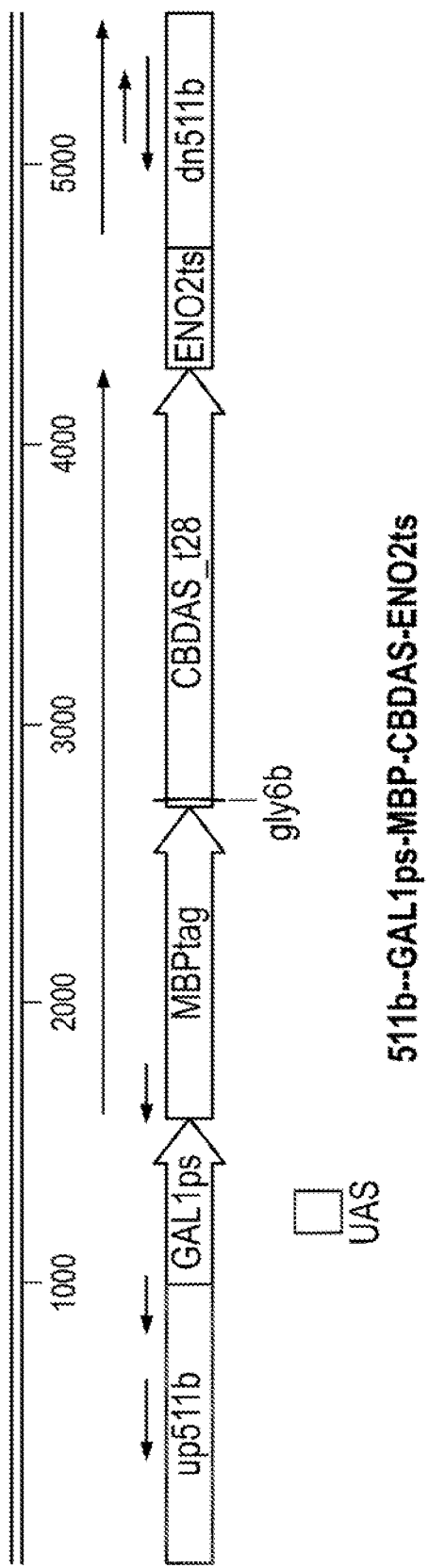
FIG. 23 depicts an expression construct to produce CBDA.
Figure 24:
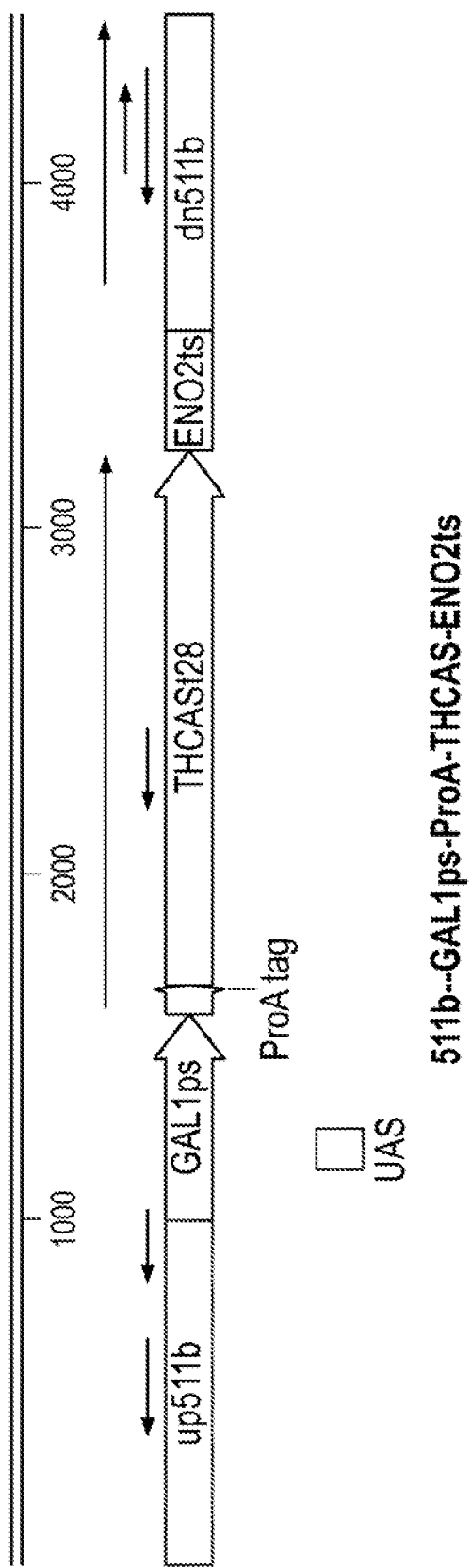
FIG. 24 depicts an expression construct to produce tetrahydrocannabinolic acid (THCA).
Figure 25:
FIG. 25 depicts an expression construct to produce THCA.
Figure 26A:
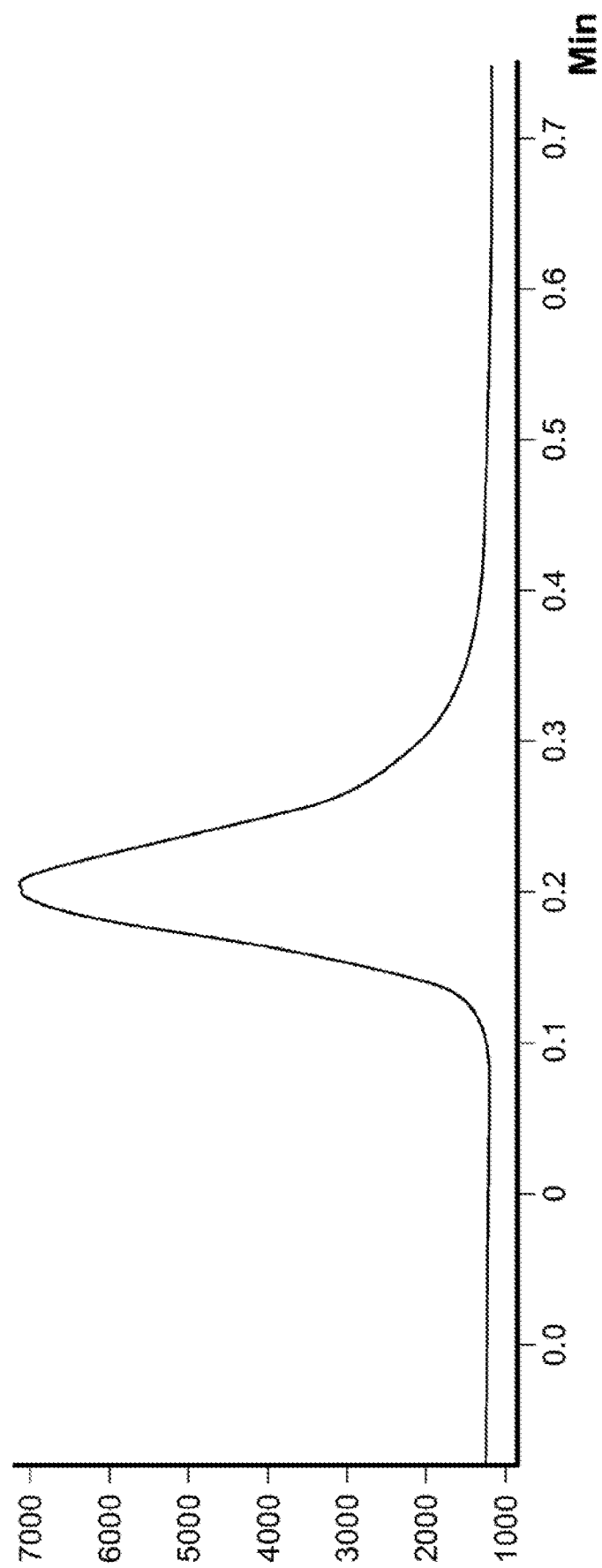
FIG. 26A, FIG. 26B, and FIG. 26C depict LC-MS traces illustrating the production of CBGA. These figures illustrate an LC-MS trace (m/z=359.2) for ethyl acetate extraction of the yL444 strain (FIG. 26A), a 10 µM CBGA standard (FIG. 26B), and a mixture of ethyl acetate extraction of yL444 and 10 µM CBGA standard (FIG. 26C). Peaks observed at 9.2 minutes indicated the presence of CBGA in the ethyl acetate extraction of yL444.
Figure 26B:
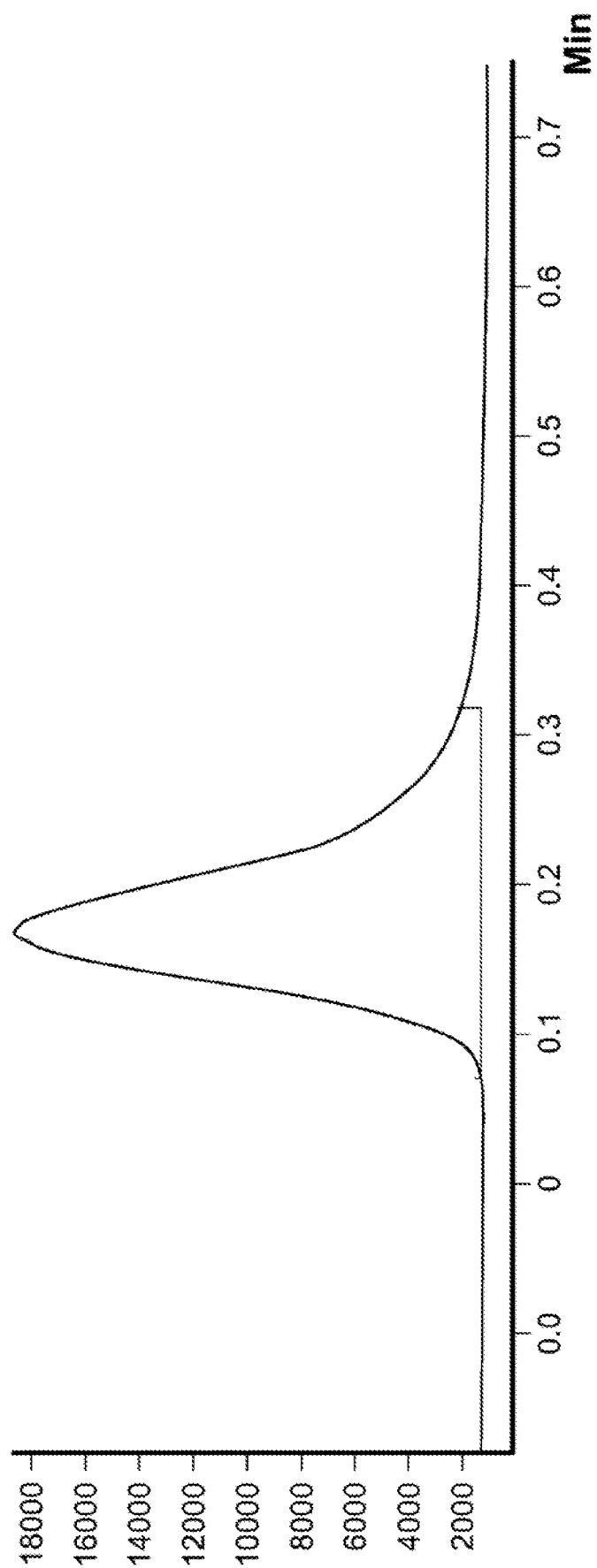
Figure 26C:
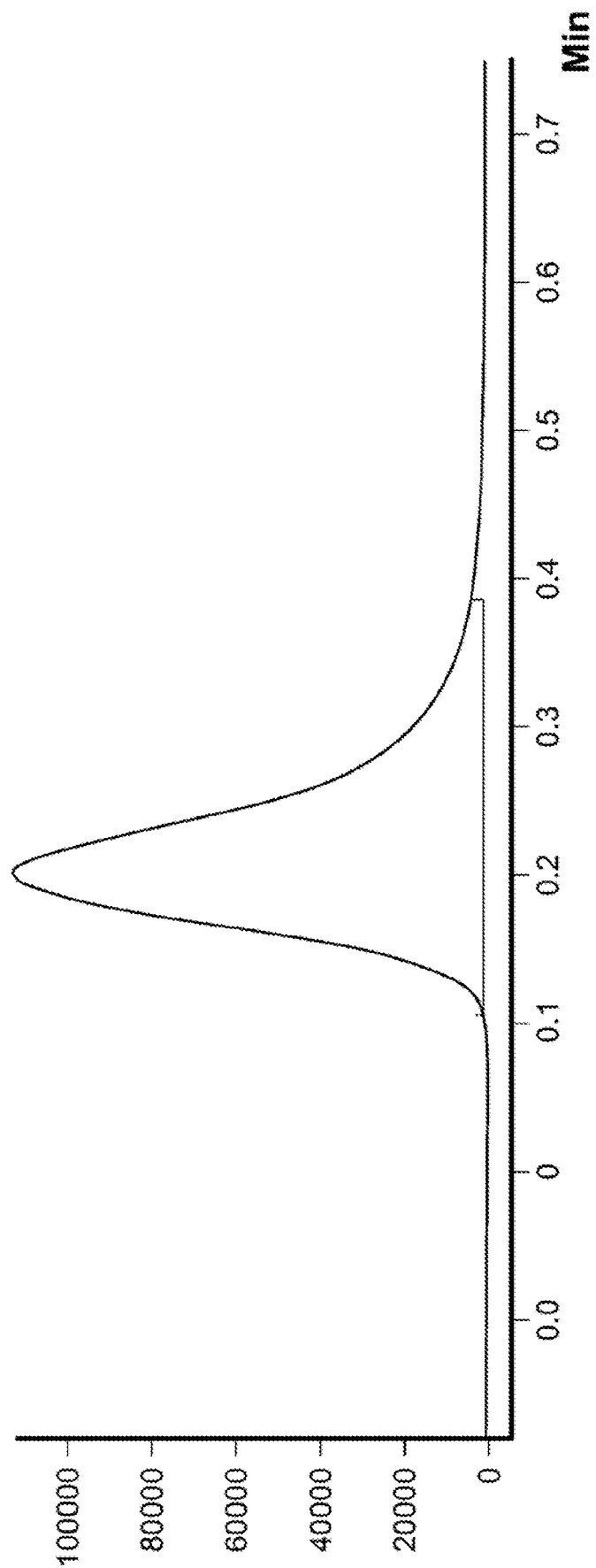

The mother cannabinoid CBGA, or derivatives thereof, was produced by a GOT polypeptide. A *C. sativa* GOT polypeptide was identified in the 1990s, yet no report was identified describing reconstituting GOT polypeptide activity in vivo. Twenty-five polypeptide variants were screened for in vivo production of CBGA in strains containing GPP pathways and exogenously fed olivetolic acid. These genes were all chromosomally integrated driven by GAL1 promoters and screened for activity in yeast extract peptone galactose (YPG) media. GC-MS and LC-MS analysis demonstrated in vivo production of CBGA from a CsPT4t polypeptide (FIGS. 26A-C). The gene sequence of the CsPT4t polypeptide is referred to as a GOT polypeptide (FIG. 20). yL444 was the strain used in the production of CBGA and expresses the following genotype: CEN.PK2-1D {1114a::GAL1p-CsPT4t-TDH1t; 308a::GAL1p-ERG20 (F96W-N127W)-TDH1t; erg9::KanMX_CTR3p-ERG9; leu2-3, 112::His3MX6_GAL1p-ERG19/GAL10p-ERG8; ura3-52::ura3/GAL1p-MvaS(A110G)/GAL10p-MvaE; his3_1::hphMX4_GAL1p-ERG12/GAL10p-IDI1; MATa} (FIGS. 6 and 20). LC-MS was carried out as follows (FIGS. 26A-C):

Column info: 2015 Kinetex XB-C18 2.1×100 mm RES6 method 10.6 min

Method info:
0-5.6 mins, 45%-73% B, 0.2 mL/min
5.6-6.2 mins, 73%-97% B, 0.2 mL/min
6.2-11.3 mins, 97% B, 0.3 mL/min
11.3-12.7, 97-45% B, 0.3 mL/min
12.7-15.5, 45% B, 0.3 mL/min
A: H2O+0.05% TFA Production of THCA and CBDA Cannabinoid synthase genes have been identified from the *Cannabis* genome (including but not limited to THCA synthase (THCAS), CBDA synthase (CBDAS), JP450547, JP454863, JP471546, JP452622). To produce THCA and CBDA, the corresponding THCA synthase and CBDA synthase, respectively, were introduced into a strain producing CBGA containing a heterologous nucleic acid encoding a CsPT4t polypeptide. The synthases were introduced as N-terminal truncated polypeptides with polypeptide tags, e.g., ProA signal sequence (MIFDGTTMSIAIGLLSTLGI-GAEA, from proteinase A with UniProt accession number F2QUG8) attached and the transcription of both synthases were under the control of GAL10 promoter. The final plasmid constructs were named as pESC-ProA-THCAS and pESC-ProA-CBDAS. Both plasmids were transformed individually into the above-mentioned strain, which has high CBGA production in the presence of olivetolic acid, to give strains yXL046 and yXL047 (FIGS. 21-25).

Figure 27:
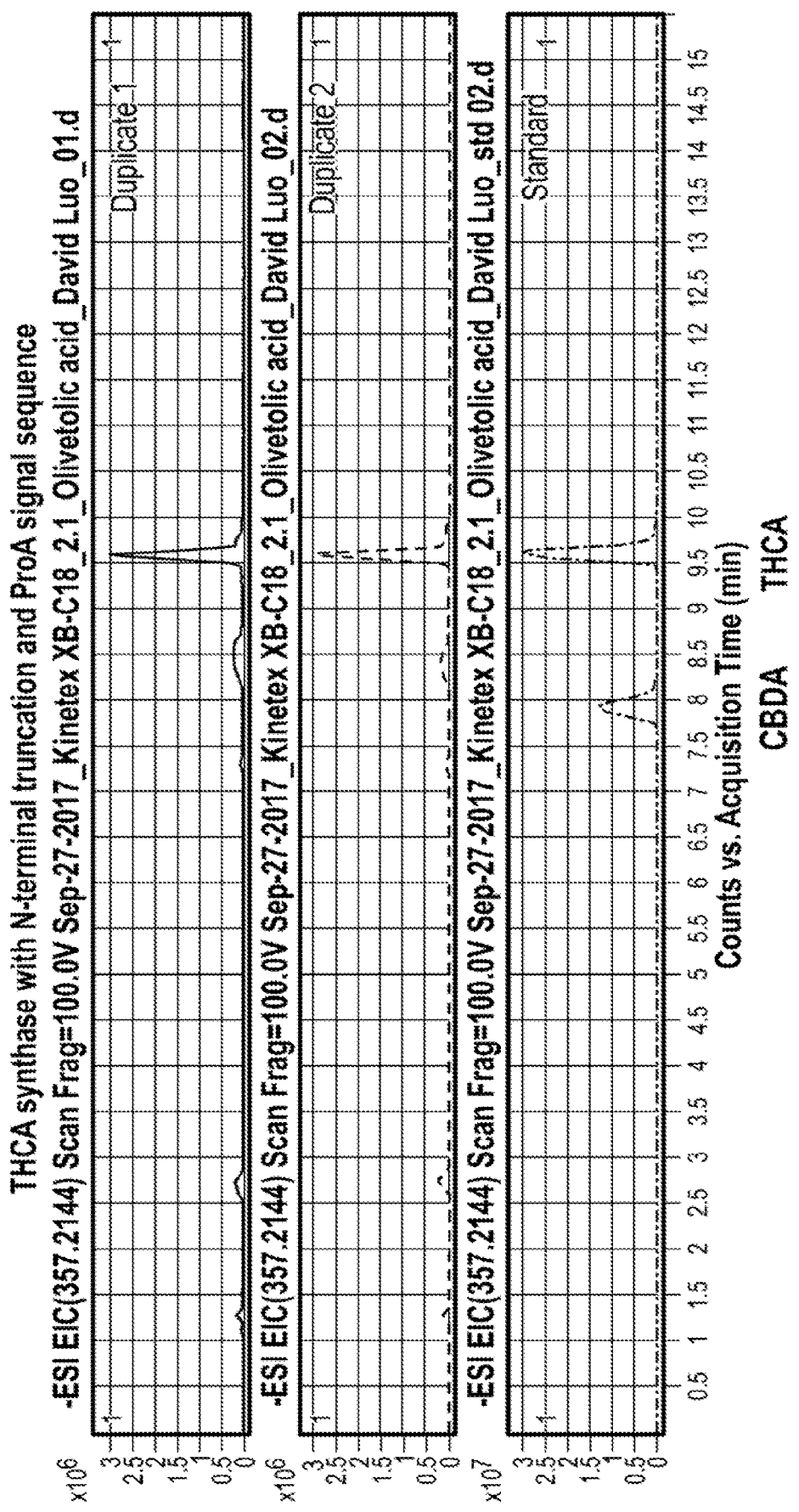
FIG. 27 depicts the production of THCA with a THCA synthase polypeptide with an N-terminal truncation and a ProA signal sequence. The figure illustrates an LC-MS trace (m/z=357.2144) for ethyl acetate extraction of yXL046 colony 1 (Duplicate 1, Top), yXL046 colony 2 (Duplicate 2, Middle), and a standard containing CBDA and THCA (Standard, Bottom). The peak at 7.9 mins indicated the presence of CBDA and the peak at 9.6 mins indicated the presence of THCA.

After confirming the transformation by PCR of THCAS or CBDAS, two colonies from each culture were inoculated into a defined medium (SC-Leu+2% Dextrose) and were incubated at 30° C. with shaking at 800 RPM. After two-day growth, the cultures were back-diluted 1:50 into inducing medium (SC-Leu+2% galactose+1 mM olivetolic acid+CuSO$_4$) and incubated at 30° C. with shaking at 800 RPM for 4 days. After 4-day incubation, equal volume of ethyl acetate was added to the expression cultures and the mixtures were subjected to three rounds of bead beating. Then the mixtures were then spun down at 5000 RPM and the organic layers were sent for LC-MS analysis, which showed the production of THCA and CBGA from the corresponding cultures (FIGS. 27 and 28).

Example 4—Generation of a Base Yeast Strain Capable of High Flux to CBGA with Olivetolic Acid Feeding CBGA production strains were created from wild-type *Saccharomyces cerevisiae* strain (CEN.PK2) by expressing genes of the mevalonate pathway polypeptides and a GOT polypeptide under control of the GAL1 or GAL10 promoter. The S21 strain comprised the following chromosomally integrated mevalonate pathway genes from *S. cerevisiae*: ERG10, ERG13, truncated HMG1 (tHMGR), ERG12, ERG8, ERG19, and IDI1. The S21 strain additionally comprised the chromosomally integrated pyruvate decarboxylase (PDC) from *Zymomonas mobilis* to increase flux from pyruvate towards acetyl-CoA.

To generate additionally strains, a mutant form of ERG20, ERG20mut, which preferentially generates GPP was added to the S21 strain with the following chromosomally integrated GOTs from *C. sativa*: CsPT1 (S164), a truncated CsPT1 (CsPT1_t75, S165), or CsPT4 (S29). Constructs used in S29, S164, and S165 are shown in Table 11.

Yeast colonies verified to contain the expected DNA assembly comprising one or more heterologous nucleic acids disclosed herein were picked into 96-well microtiter plates containing 360 μL of YPD (10 g/L yeast extract, 20 g/L Bacto peptone, 20 g/L dextrose (glucose)) and sealed with a breathable film seal. Cells were cultured at 30° C. in a high capacity microtiter plate incubator shaking at 1000 rpm and 80% humidity for 3 days until the cultures reached carbon exhaustion. The growth-saturated cultures were subcultured into fresh plates containing YPGAL and olivetolic acid (10 g/L yeast extract, 20 g/L Bacto peptone, 20 g/L galactose, 1 g/L glucose and 1 mM olivetolic acid) by taking 14.4 μL from the saturated cultures and diluting into 360 μL of fresh media and sealed with a breathable film seal. Genetically modified host cells in the production media were cultured at 30° C. in a high capacity microtiter plate shaker at 1000 rpm and 80% humidity for an additional 3 days prior to extraction and analysis. Upon completion, 100 μL of whole cell broth was diluted into 900 μL of methanol, sealed with a foil seal, and shaken at 1500 rpm for 60 seconds to extract the cannabinoids. After shaking, the plate was centrifuged at 1000×g for 60 seconds to remove any solids. After centrifugation, 12 μL of supernatant was transferred to a fresh assay plate containing 228 μL of methanol, sealed with a foil seal, shaken for 60 seconds at 900 rpm, and analyzed by LC-MS.

Samples were analyzed by LC-MS mass spectrometer (Agilent 6470) using an Agilent Poroshell 120 Phenyl Hexyl 2.1×50 mm, 1.9 μm analytical column with the following gradient (Mobile Phase A: LC-MS grade water with 0.1% formic acid; Mobile Phase B: LC-MS grade acetonitrile with 0.1% formic acid):

| Time (minutes) | % B |
| --- | --- |
| 0 | 40 |
| 0.1 | 40 |
| 0.6 | 60 |
| 1 | 65 |
| 1.01 | 95 |
| 2.01 | 95 |
| 2.02 | 40 |
| 2.5 | 40 |

Figure 77:
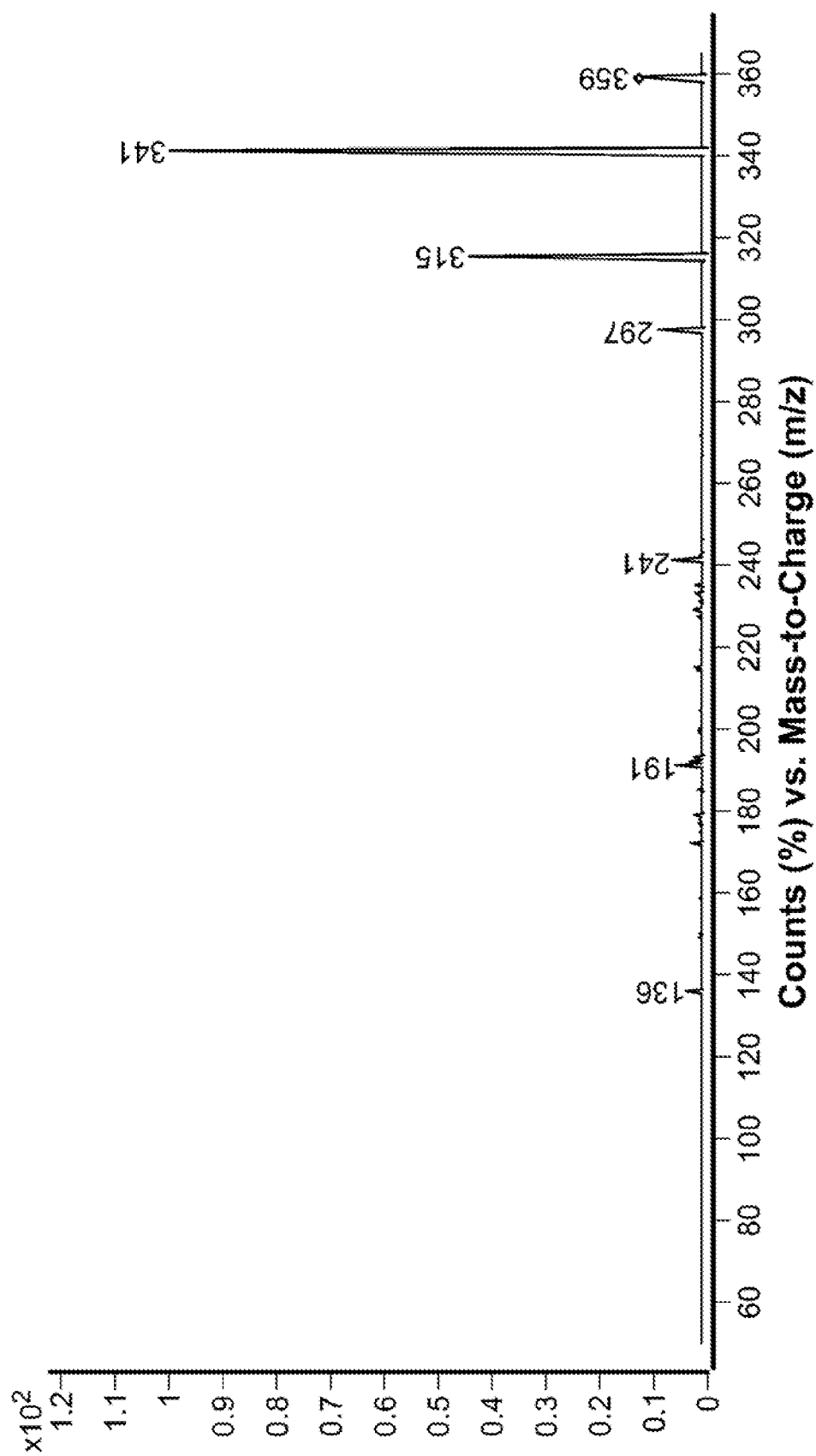
FIG. 77 depicts the MS/MS spectrum of the CBGA peak produced from a CsPT4 polypeptide expressing strain (S29).
Figure 78:
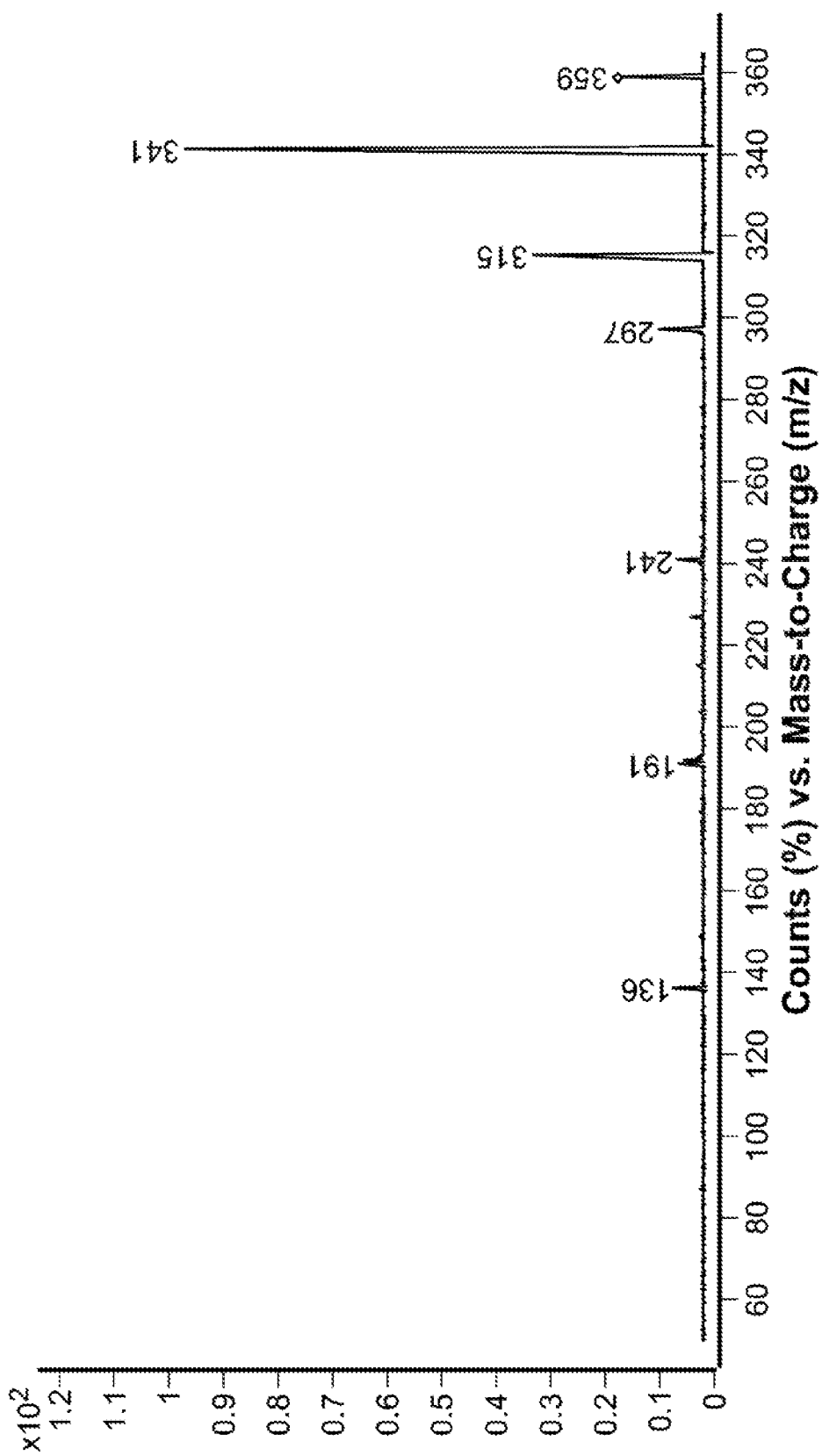
FIG. 78 depicts the MS/MS spectrum of an authentic CBGA standard.
Figure 79:
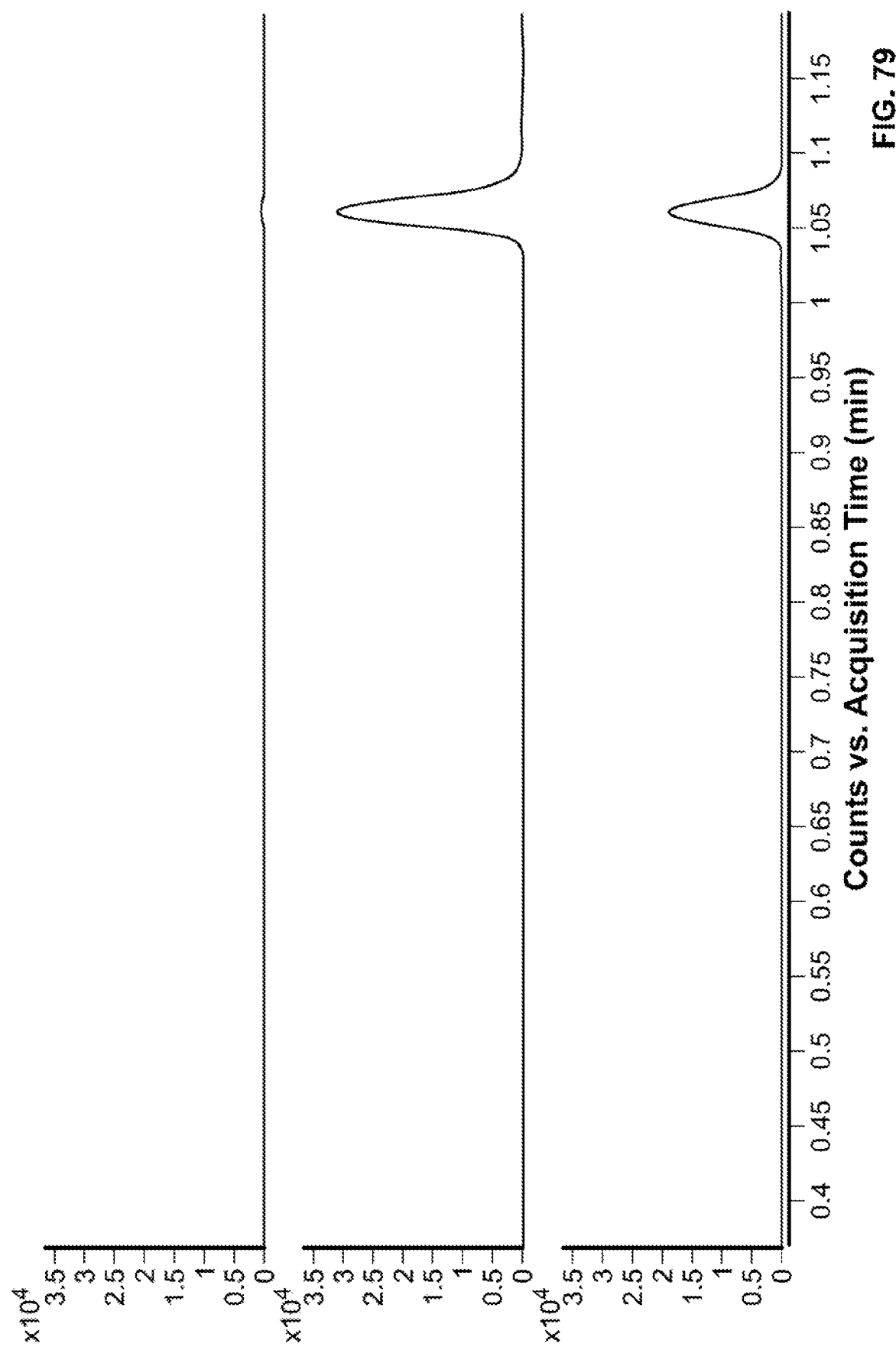
FIG. 79 depicts CBGA produced by a CsGOT polypeptide at 1.06 min (top), CBGA produced by a CsPT4 polypeptide at 1.06 min (middle), and authentic CBGA standard at 1.06 min (bottom).
Figure 80:
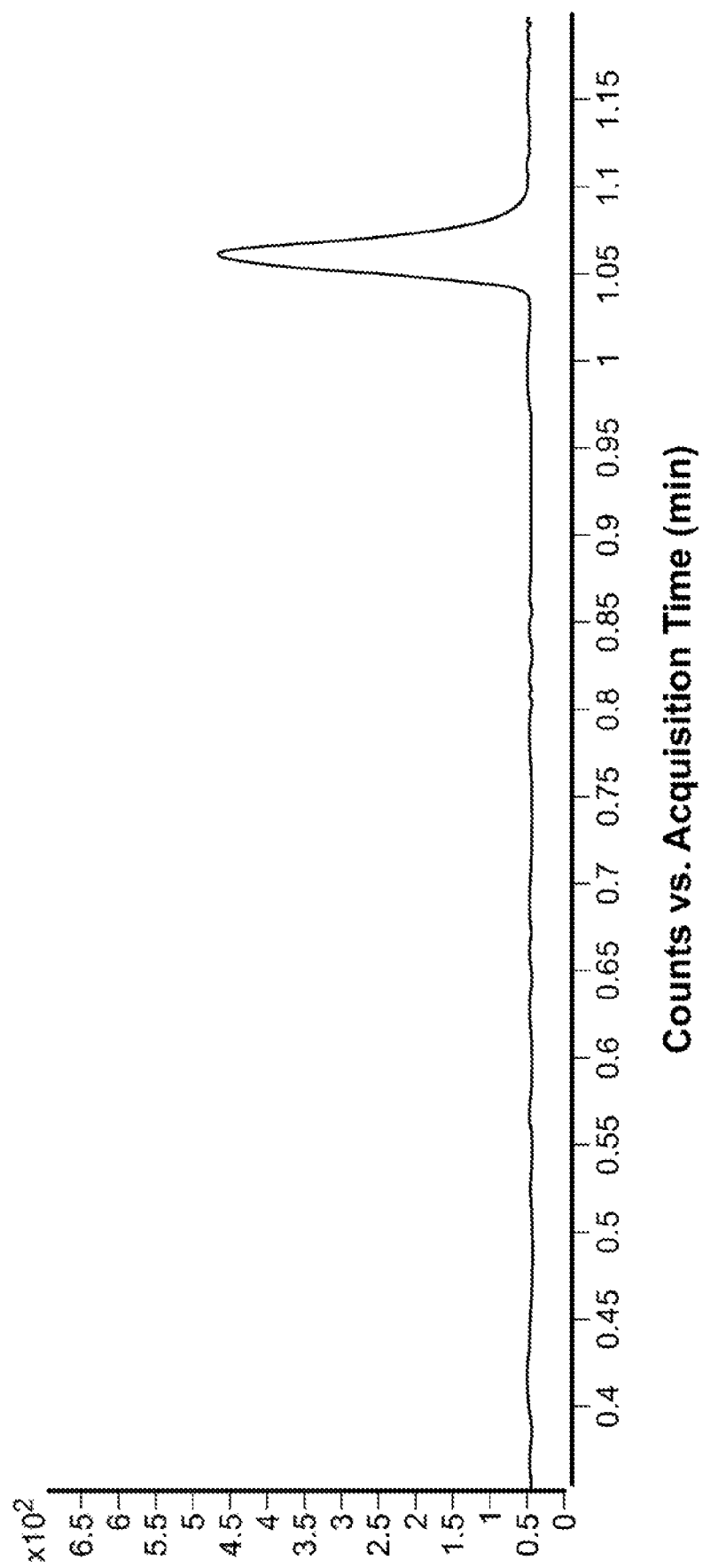
FIG. 80 depicts CBGA produced by a CsGOT polypeptide at 1.06 min (scale×$10^2$ units).
Figure 81:
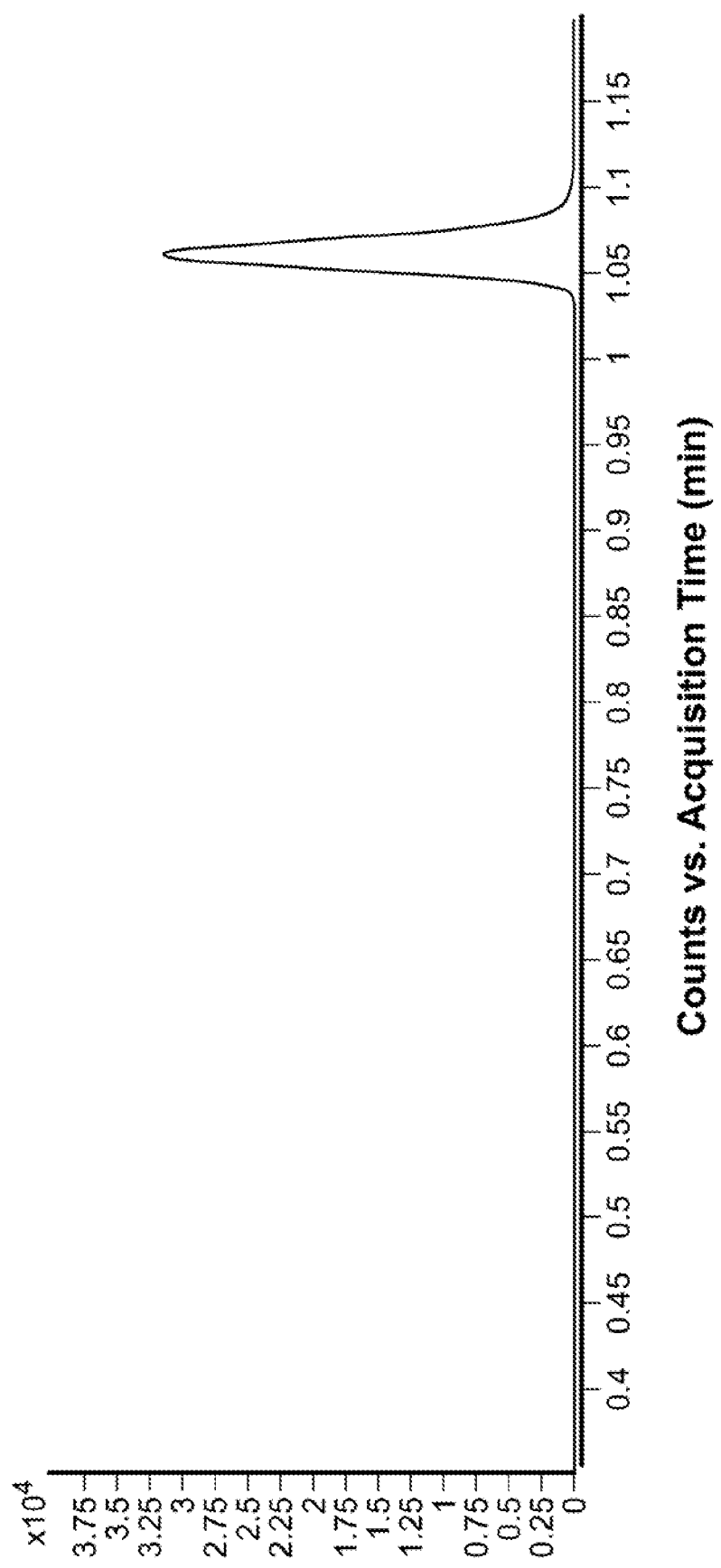
FIG. 81 depicts CBGA produced by a CsPT4 polypeptide at 1.06 min scale×$10^4$ units)
Figure 82:
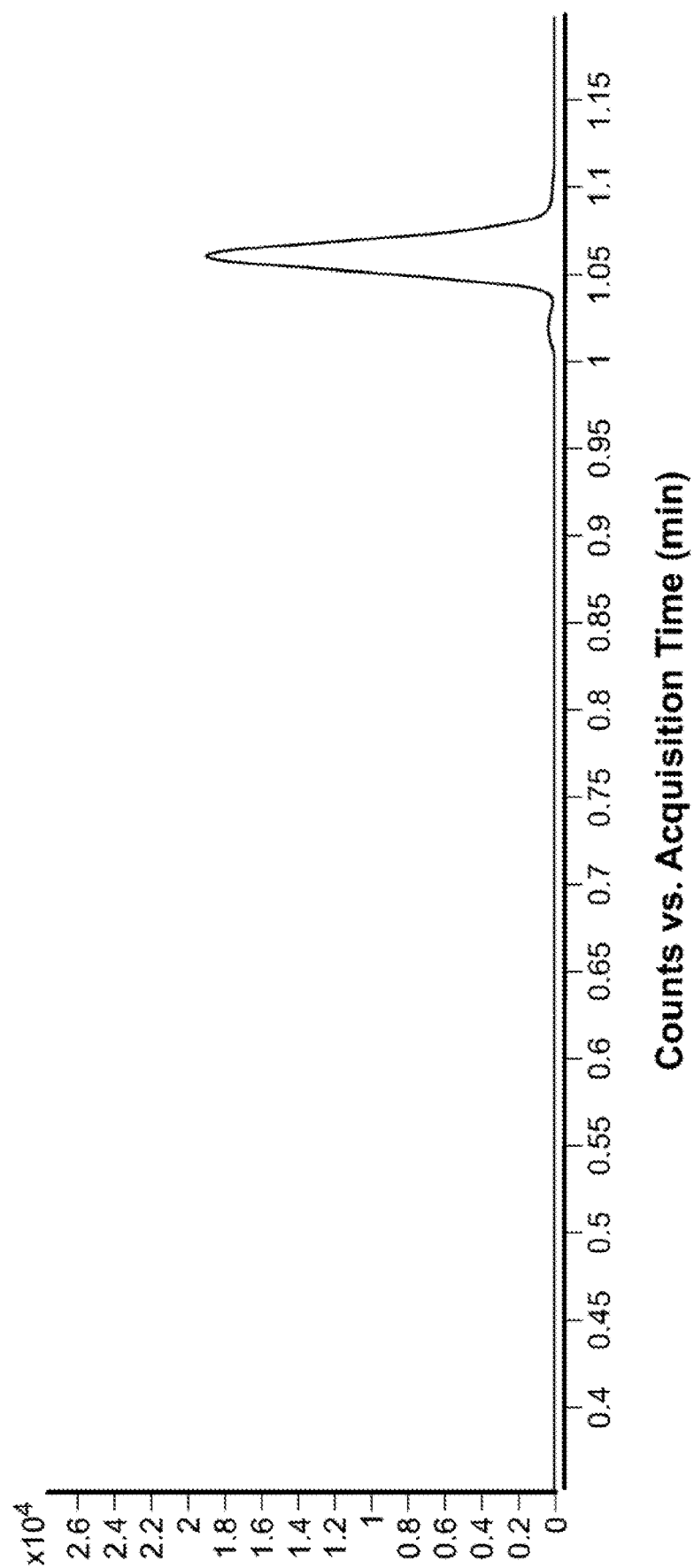
FIG. 82 depicts an authentic CBGA standard at 1.06 min (scale×$10^4$ units).

The mass spectrometer was operated in negative ion multiple reaction monitoring mode. Each cannabinoid was identified by retention time, determined from an authentic standard, and MRM transition (see FIGS. 77 and 78):

| Compound Name | Q1 Mass (Da) | Q3 Mass (Da) |
|---|---|---|
| CBGA | 359.2 | 341.1 |
| CBGA | 359.2 | 315.2 |

CsPT1 polypeptide and CsPT1_t75 polypeptide produced equivalent amounts of CBGA in vivo (1.3 mg/L CBGA). However, CsPT4 polypeptide produced 216 mg/L CBGA in vivo (see FIGS. 79-82).

Example 5—Determining the Minimal Catalytic Domain of CsPT4

To determine the minimal catalytic domain of CsPT4 polypeptide required for the conversion of GPP and olivetolic acid to CBGA, multiple N-terminal truncations of the CsPT4 polypeptide were generated (see Table 11) and expressed in vivo in the S21 strain with feeding of 1 mM olivetolic acid. Only full length CsPT4 polypeptide and CsPT4_t76 polypeptide (CsPT4t) displayed activity in vivo (Table 4).

TABLE 4

Screening of CsPT4 truncated polypeptides

| CsPT4 construct | Strain | Peak intensity |
|---|---|---|
| CsPT4 | S29 | 8901 |
| CsPT4_t76 | S147 | 6859 |
| CsPT4_t112 | S166 | 19 |
| CsPT4_t131 | S167 | 24 |
| CsPT4_t142 | S168 | 20 |
| CsPT4_t166 | S169 | 21 |
| CsPT4_t186 | S170 | 29 |

Example 6—Generation of a Base Yeast Strain Capable of High Flux to CBGA with Hexanoic Acid (Caproic Acid) Feeding To convert the high flux strain for the production of CBGA with olivetolic acid (S29) to a high flux stain for the production of CBGA with hexanoic acid, genes responsible for the production to olivetolic acid from fatty acids were expressed using the GAL1 or GAL10 promoter in S29. The strain comprised the following chromosomally integrated olivetolic acid pathway genes from *C. sativa*: three copies of TKS and three copies of OAC. Three different strains were generated with two copies of *C. sativa* AAE1 (S78), two copies of *C. sativa* AAE3 (S81), or two copies of *S. cerevisiae* FAA2 (S83) (see Table 11 for information on the strains). The strains were grown and tested as in Examples 4 and 5 but with 2 mM hexanoic acid added to the media instead of 1 mM olivetolic acid. Production of CBGA by the strains was observed (Table 5).

TABLE 5

Generation of CBGA

| | | Titer (mg/L) | | |
|---|---|---|---|---|
| Feed compound | Product | AAE1v1 (S78) | AAE3-Ctrunc (S81) | FAA2 (S83) |
| Hexanoic acid | CBGA | 38.5 | 32.1 | 35.1 |

Figure 83:
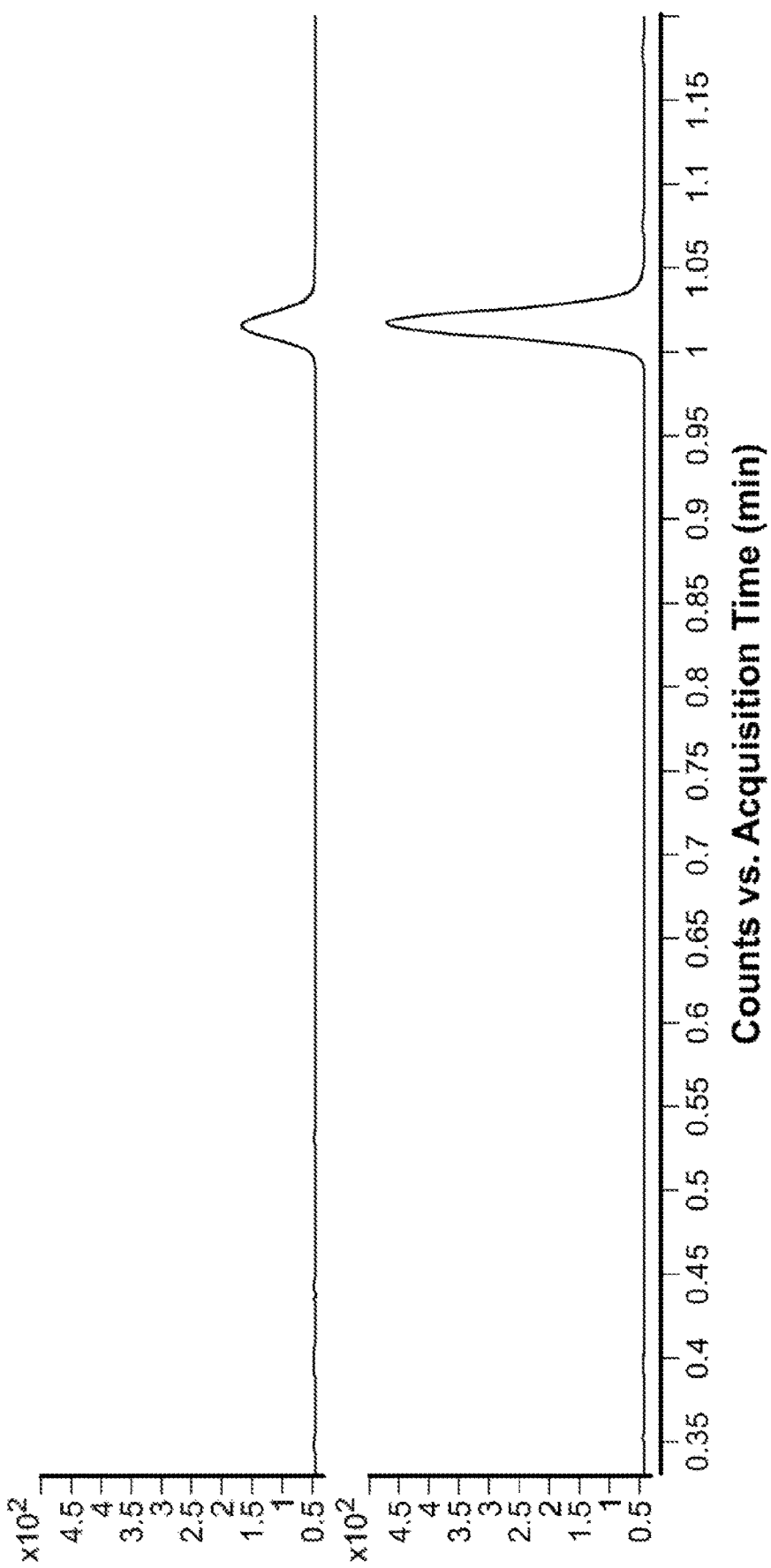
FIG. 83 depicts CBDA produced by S34 at 1.02 min (top) and an authentic CBDA standard at 1.02 min (bottom).
Figure 84:
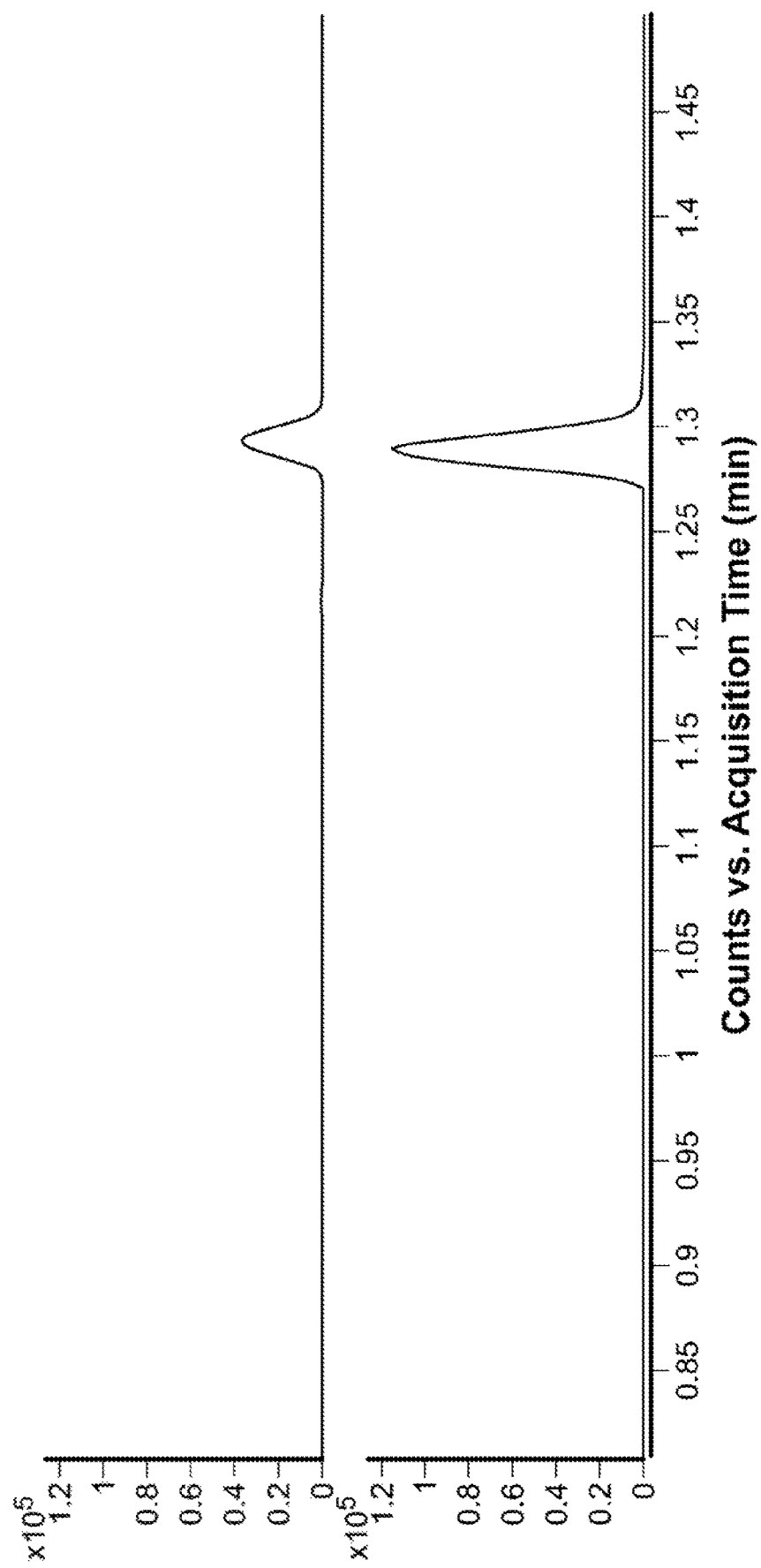
FIG. 84 depicts THCA produced from strain D123 at 1.29 min (top) and an authentic THCA standard at 1.29 min (bottom).

Example 7—Generation of a Base Yeast Strain Capable of High Flux to CBDA and THCA To convert the high flux strain for the production of CBGA to a high flux strain for the production of CBDA or THCA, a heterologous nucleic acid encoding CBDA synthase polypeptide (S34) or THCA synthase polypeptide (S123) was added to Strain S29 (see Table 11 for information on the strains). The strains were tested as in Examples 4 and 5 with 1 mM olivetolic acid in the media. CBDA and THCA were produced by the strains, as shown in FIGS. 83 and 84.

Example 8—Feeding of Cannabinoid Precursor Derivatives to Yeast to Produce Rare and Non-Naturally Occurring CBGA Derivatives Strains from Example 6 (S78, S81, and S83) were grown as in Examples 4 and 5 but with 2 mM of a carboxylic acid (detailed in Table 6) added to the media and analyzed as in Example 4. Table 6 details the products produced by the strains (product peak intensity).

TABLE 6

CBGA Derivatives Produced

| Feed compound | Product (IUPAC name) | Transition 1 | Transition 2 | AAE1v1 (S78) | AAE3-Ctrunc (S81) | FAA2 (S83) |
|---|---|---|---|---|---|---|
| 2-methyl hexanoic acid | 3-[(2E)-3,7-dimethylocta-2,6-dien-1-yl]-6-(hexan-2-yl)-2,4-dihydroxybenzoic acid | 373 --> 355 | 373 --> 329 | 1136 | 1255 | 1301 |
| 4-methyl hexanoic acid | 3-[(2E)-3,7-dimethylocta-2,6-dien-1-yl]-2,4-dihydroxy-6-(3-methylpentyl)benzoic acid | 373 --> 355 | 373 --> 329 | 82453 | 91493 | 82517 |

TABLE 6-continued

| | CBGA Derivatives Produced | | | | | |
|---|---|---|---|---|---|---|
| Feed compound | Product (IUPAC name) | Transition 1 | Transition 2 | AAE1v1 (S78) | AAE3-Ctrunc (S81) | FAA2 (S83) |
| 5-methyl hexanoic acid | 3-[(2E)-3,7-dimethylocta-2,6-dien-1-yl]-2,4-dihydroxy-6-(4-methylpentyl)benzoic acid | 373 --> 355 | 373 --> 329 | 76145 | 77270 | 77145 |
| 2-hexenoic acid | 3-[(2E)-3,7-dimethylocta-2,6-dien-1-yl]-2,4-dihydroxy-6-[(1E)-pent-1-en-1-yl]benzoic acid | 357 --> 339 | 357 --> 313 | 311 | 536 | 588 |
| 3-hexenoic acid | 3-[(2E)-3,7-dimethylocta-2,6-dien-1-yl]-2,4-dihydroxy-6-[(2E)-pent-2-en-1-yl]benzoic acid | 357 --> 339 | 357 --> 313 | 90422 | 104366 | 112440 |
| 5-hexenoic acid | 3-[(2E)-3,7-dimethylocta-2,6-dien-1-yl]-2,4-dihydroxy-6-(pent-4-en-1-yl)benzoic acid | 357 --> 339 | 357 --> 313 | 302499 | 325854 | 365798 |
| butanoic acid | 3-[(2E)-3,7-dimethylocta-2,6-dien-1-yl]-2,4-dihydroxy-6-propylbenzoic acid | 331 --> 313 | 331 --> 287 | 92181 | 106229 | 103368 |
| pentanoic acid | 3-[(2E)-3,7-dimethylocta-2,6-dien-1-yl]-2,4-dihydroxy-6-butylbenzoic acid | 345 --> 327 | 345 --> 301 | 224003 | 232206 | 236366 |
| heptanoic acid | 3-[(2E)-3,7-dimethylocta-2,6-dien-1-yl]-2,4-dihydroxy-6-hexylbenzoic acid | 373 --> 355 | 373 --> 329 | 66544 | 67766 | 66570 |
| octanoic acid | 3-[(2E)-3,7-dimethylocta-2,6-dien-1-yl]-2,4-dihydroxy-6-heptylbenzoic acid | 387 --> 369 | 387 --> 343 | 4225 | 3212 | 3603 |
| 5-chloro pentanoic acid | 6-(4-chlorobutyl)-3-[(2E)-3,7-dimethylocta-2,6-dien-1-yl]-2,4-dihydroxybenzoic acid | 379 -->361 | 379 --> 335 | 1023 | 947 | 902 |
| 5-(methyl sulfanyl)pentanoic acid | 3-[(2E)-3,7-dimethylocta-2,6-dien-1-yl]-2,4-dihydroxy-6-[4-(methylsulfanyl)butyl]benzoic acid | 391 --> 373 | 391 --> 347 | 18396 | 18704 | 19412 |

Example 9—Feeding of Cannabinoid Precursor Derivatives to Yeast to Produce Rare and Non-Naturally Occurring CBDA Derivatives Strains with (S34) or without a CBDA synthase polypeptide (S29) were tested as in Examples 4 and 5 with 1 mM of an olivetolic acid derivative (detailed in Table 7). Table 7 details the products produced by the strains.

TABLE 7

CBDA Derivatives Produced

| Feed compound | Product (IUPAC name) | Transition 1 | Transition 2 | CBGA derivative titer (mg/L) (S29) | CBDA derivative titer (mg/L) (S34) |
|---|---|---|---|---|---|
| Orsellinic Acid | 3-[(2E)-3,7-dimethylocta-2,6-dien-1-yl]-2,4-dihydroxy-6-methylbenzoic acid | 303 --> 285 | 303 --> 259 | 1.86 | 1.05 |
| Divarinic Acid | 3-[(2E)-3,7-dimethylocta-2,6-dien-1-yl]-2,4-dihydroxy-6-propylbenzoic acid | 331 --> 313 | 331 --> 287 | 29.54 | 3.06 |

Example 10—Feeding of Cannabinoid Precursors to Yeast to Produce CBDA or CBGA As there are numerous ways to produce cannabinoid precursors (e.g., GPP), a number of different genes were tested in vivo to optimize cannabinoid production. Different GPP synthase polypeptides, CBDA synthase polypeptides, TKS polypeptides, OAC polypeptides, medium and long chain fatty acyl-CoA synthetase polypeptides were tested in various combinations as described below (see Table 11 for information on the strains).

Strains were constructed with different GPP synthase polypeptides to identify the best producer of GPP for production of CBGA when fed 1 mM olivetolic acid. Strain S21 was transformed with heterologous nucleic acids encoding a CsPT4 polypeptide and a GPP synthase polypeptide. CBGA titer was measured as described in Example 4. CBGA titers, titer standard deviations (SD) and number of replicates tested are indicated in Table 8.

TABLE 8

Production of CBGA

| Product | Strain | Titer (mg/L) | SD | n |
|---|---|---|---|---|
| CBGA | S29 | 215.6 | 12.2 | 8 |
| CBGA | S114 | 6.8 | 0.7 | 3 |
| CBGA | S116 | 15.5 | 2.0 | 4 |
| CBGA | S108 | 8.5 | 1.7 | 4 |
| CBGA | S112 | 9.9 | 1.6 | 4 |
| CBGA | S104 | 10.2 | 1.6 | 3 |
| CBGA | S115 | 9.2 | 1.9 | 4 |
| CBGA | S118 | 5.1 | NA | 1 |

To optimize production of CBDA, strain S29 was transformed with a series of constructs with two copies of a CBDA synthase polypeptide encoding heterologous nucleic acid and grown as in Examples 4 and 5 with 1 mM olivetolic acid. CBDA was measured as described in Example 4. CBDA peak intensity, peak intensity standard deviations (SD) and number of replicates tested are indicated in Table 9.

TABLE 9

Production of CBDA

| Product | Strain | Peak Area | SD | n |
|---|---|---|---|---|
| CBDA | S34 | 1651 | 329 | 4 |
| CBDA | S35 | 831 | 72 | 4 |

TABLE 9-continued

Production of CBDA

| Product | Strain | Peak Area | SD | n |
|---|---|---|---|---|
| CBDA | S37 | 505 | 26 | 4 |
| CBDA | S38 | 658 | 31 | 4 |
| CBDA | S39 | 1274 | 85 | 4 |
| CBDA | S41 | 2129 | 462 | 4 |
| CBDA | S42 | 72 | 4 | 4 |
| CBDA | S43 | 419 | 481 | 4 |
| CBDA | S44 | 758 | 68 | 4 |
| CBDA | S45 | 1253 | 177 | 4 |
| CBDA | S46 | 670 | 112 | 4 |
| CBDA | S47 | 300 | 15 | 4 |

To optimize production of CBGA from hexanoic acid, different combinations of TKS polypeptide, OAC polypeptide, and medium and long chain fatty acyl-CoA synthetase polypeptide were tested in vivo. All strains were daughters or granddaughters of strain S29. All strains were tested as described in Example 4 with 2 mM hexanoic acid added to the production media. CBGA titers, titer standard deviations (SD) and number of replicates tested are indicated in Table 10.

TABLE 10

Production of CBGA

| Product | Strain | Titer (mg/L) | SD | n |
|---|---|---|---|---|
| CBGA | S31 | 53.6 | 12.2 | 8 |
| CBGA | S49 | 55.7 | 9.3 | 8 |
| CBGA | S50 | 22.9 | 7.0 | 8 |
| CBGA | S90 | 67.5 | 2.8 | 4 |
| CBGA | S91 | 63.5 | 4.2 | 4 |
| CBGA | S78 | 38.5 | 2.5 | 4 |
| CBGA | S80 | 37.5 | 1.8 | 4 |
| CBGA | S81 | 32.1 | 5.8 | 4 |
| CBGA | S82 | 35.1 | 7.0 | 4 |
| CBGA | S83 | 35.1 | 2.6 | 4 |
| CBGA | S84 | 36.4 | 3.5 | 4 |
| CBGA | S85 | 34.4 | 4.3 | 4 |
| CBGA | S86 | 36.6 | 1.8 | 4 |

TABLE 10-continued

Production of CBGA

| Product | Strain | Titer (mg/L) | SD | n |
|---|---|---|---|---|
| CBGA | S87 | 32.2 | 4.9 | 4 |
| CBGA | S88 | 40.9 | 1.4 | 4 |
| CBGA | S89 | 39.3 | 2.7 | 4 |
| CBGA | S94 | 59.6 | 7.9 | 8 |
| CBGA | S95 | 58.5 | 9.2 | 8 |
| CBGA | S97 | 72.9 | 5.5 | 8 |

TABLE 11

Constructs and strains used in the Examples

Figure 29A:
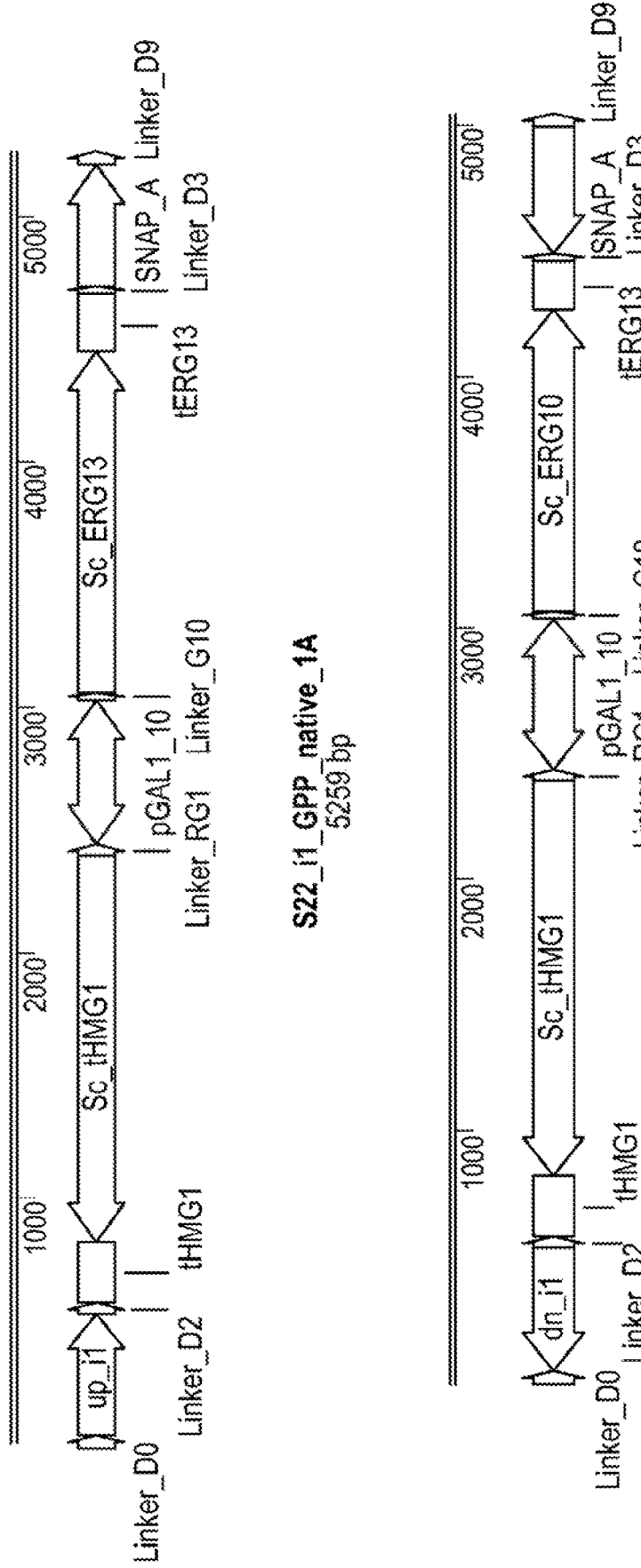
FIGS. 29A and 29B depict expression constructs used in the production of the S21 strain. The expression constructs depicted in FIGS. 29A and 29B are also used in the production of following strains: S29, S31, S34, S35, S37, S38, S39, S41, S42, S43, S44, S45, S46, S47, S49, S50, S51, S78, S80, S81, S82, S83, S84, S85, S86, S87, S88, S89, S90, S91, S94, S95, S97, S104, S108, S112, S114, S115, S116, S118, S123, S147, S164, S165, S166, S167, S168, S169, and S170.
Figure 29B:
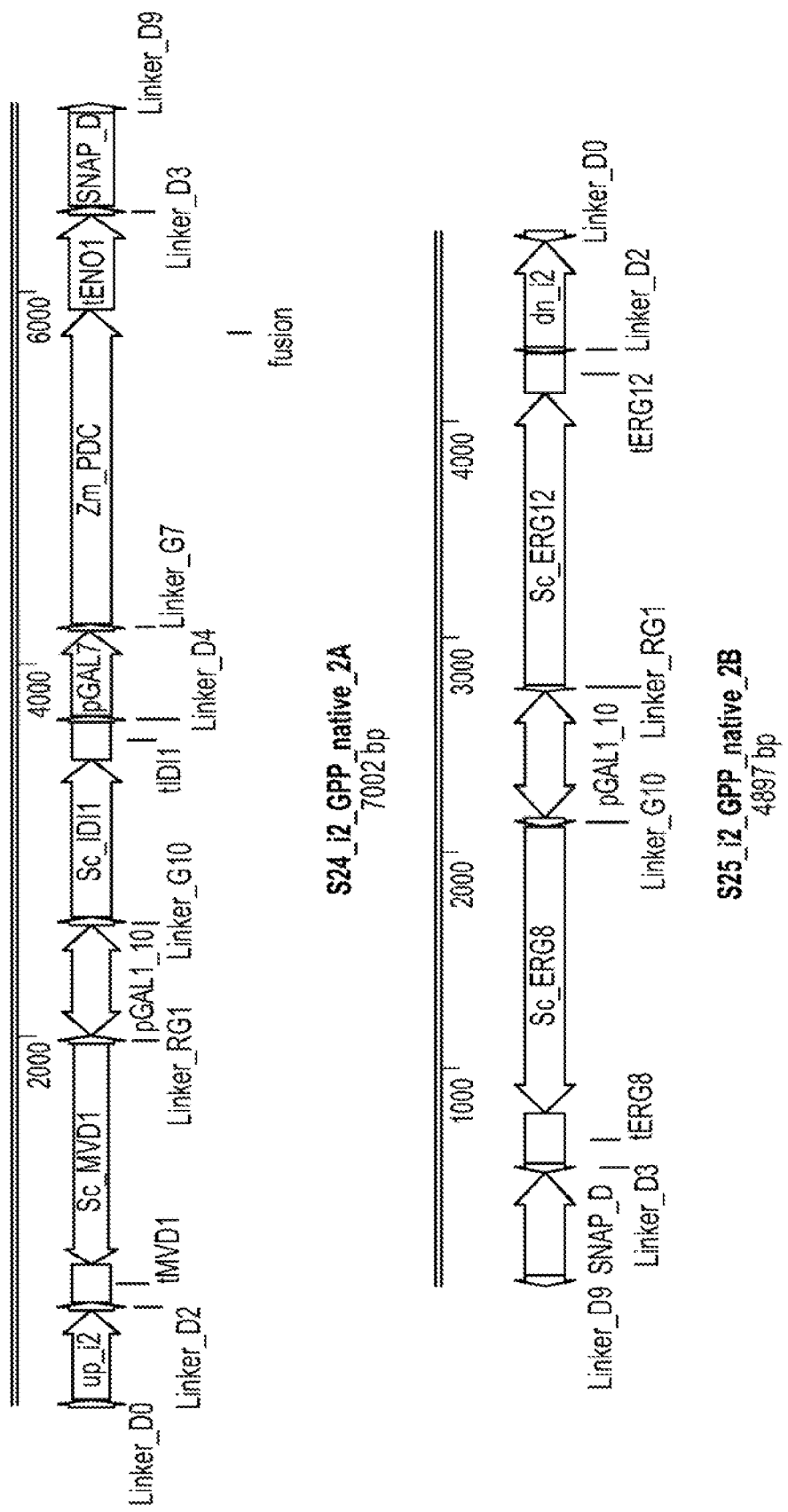
Figure 30A:
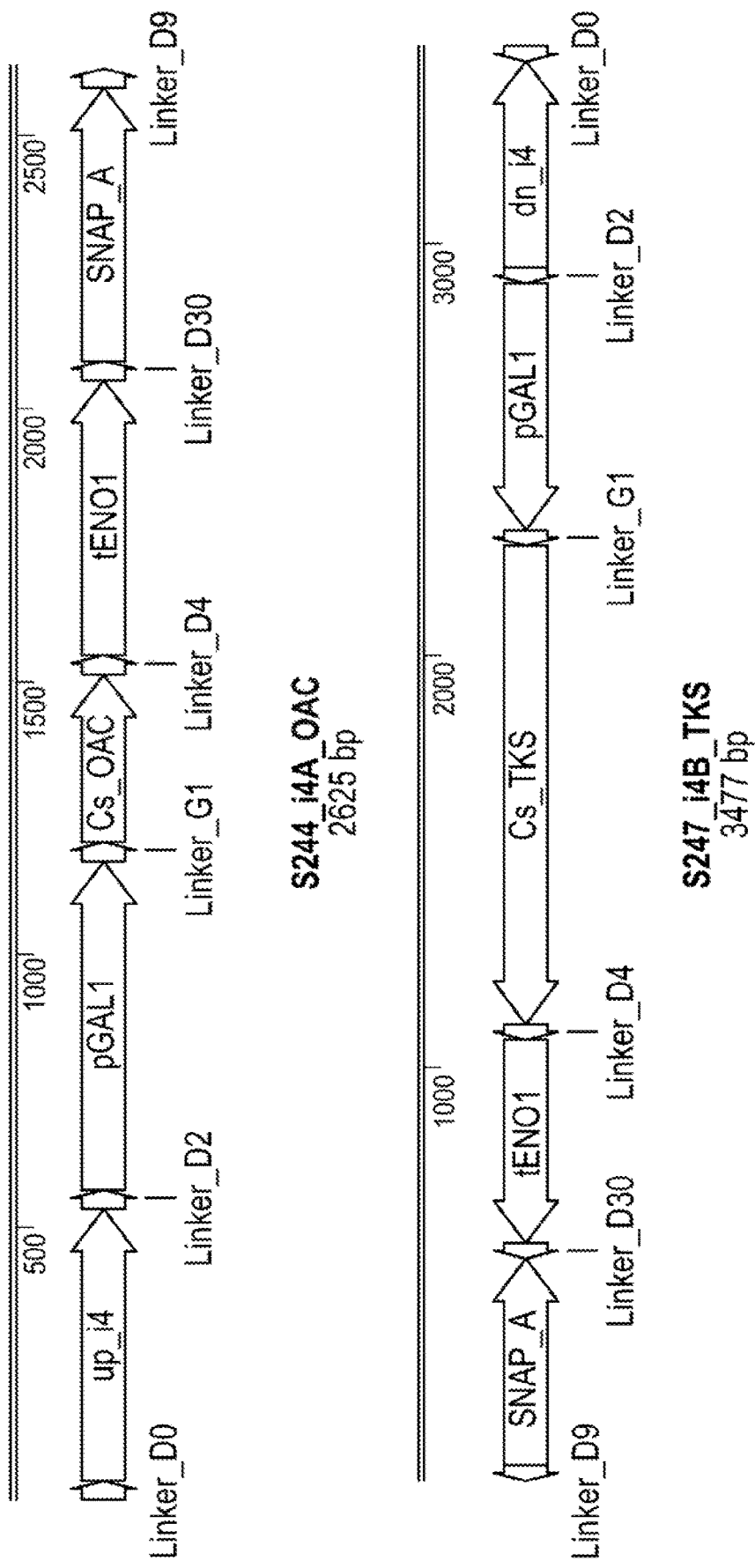
FIGS. 30A, 30B, and 30C depict expression constructs used in the production of the S31 strain. The expression constructs depicted in FIGS. 30A, 30B, and 30C are also used in the production of following strains: S94, S95, and S97.
Figure 30B:
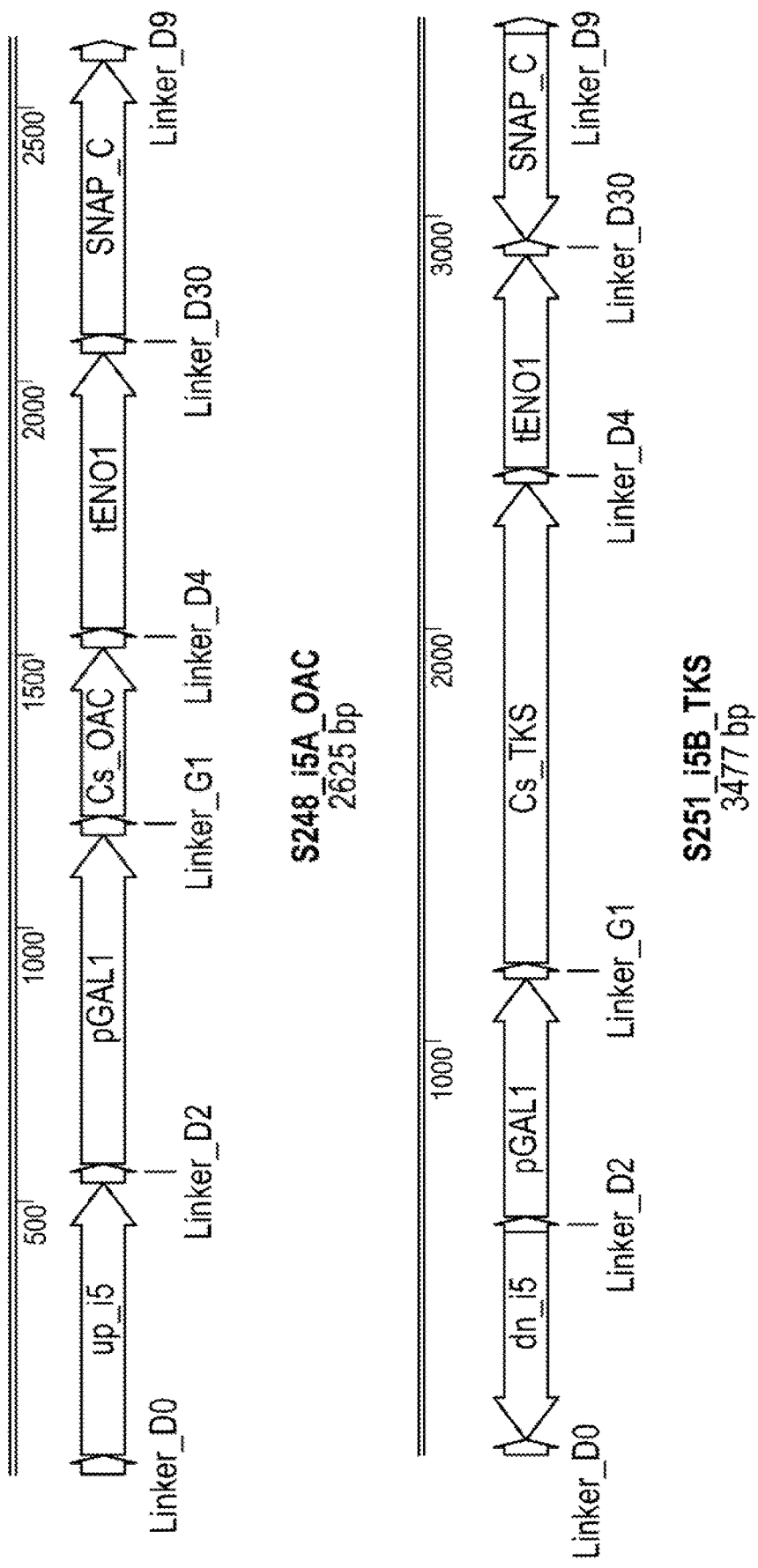
Figure 30C:
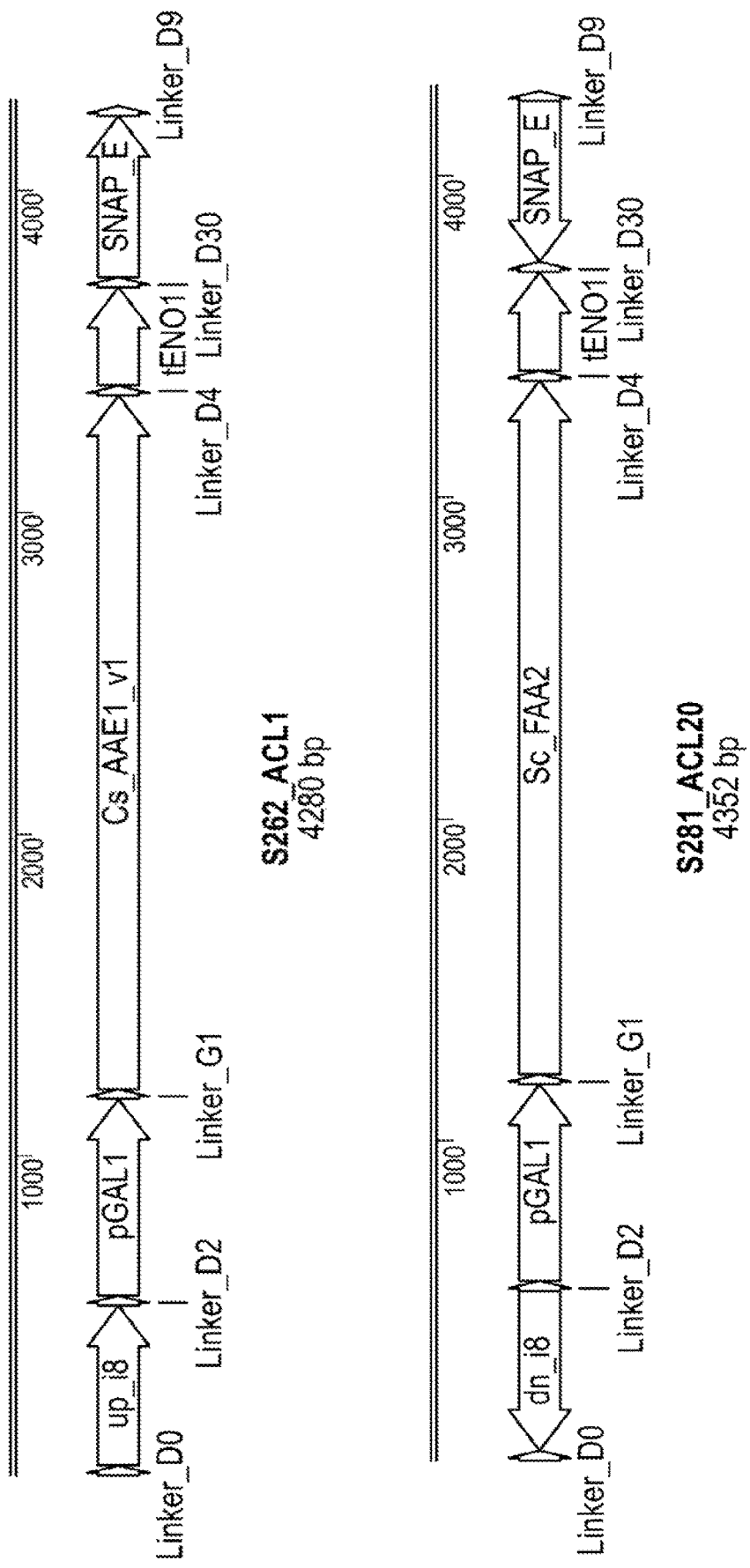
Figure 31:
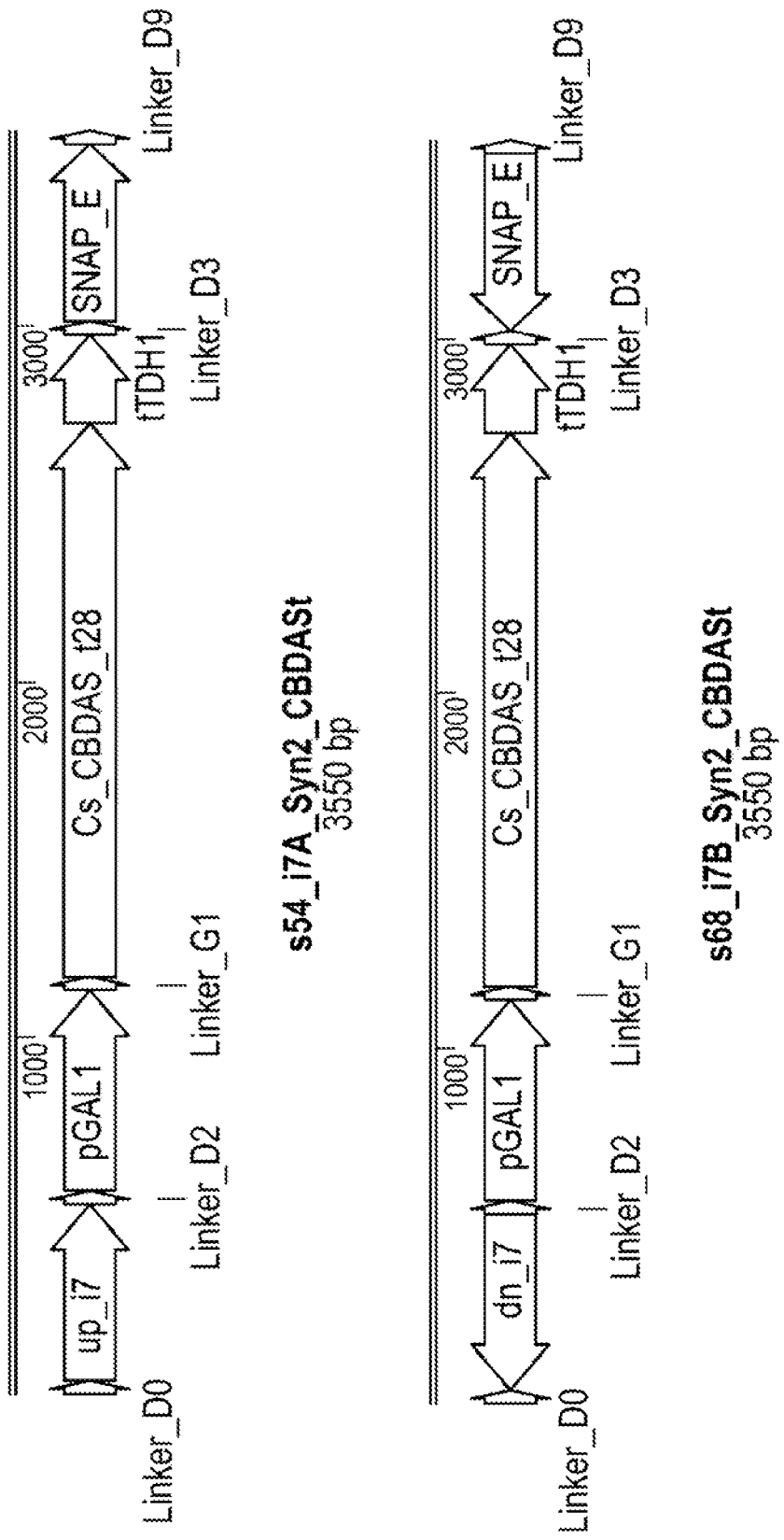
FIG. 31 depicts expression constructs used in the production of the S35 strain.
Figure 32:
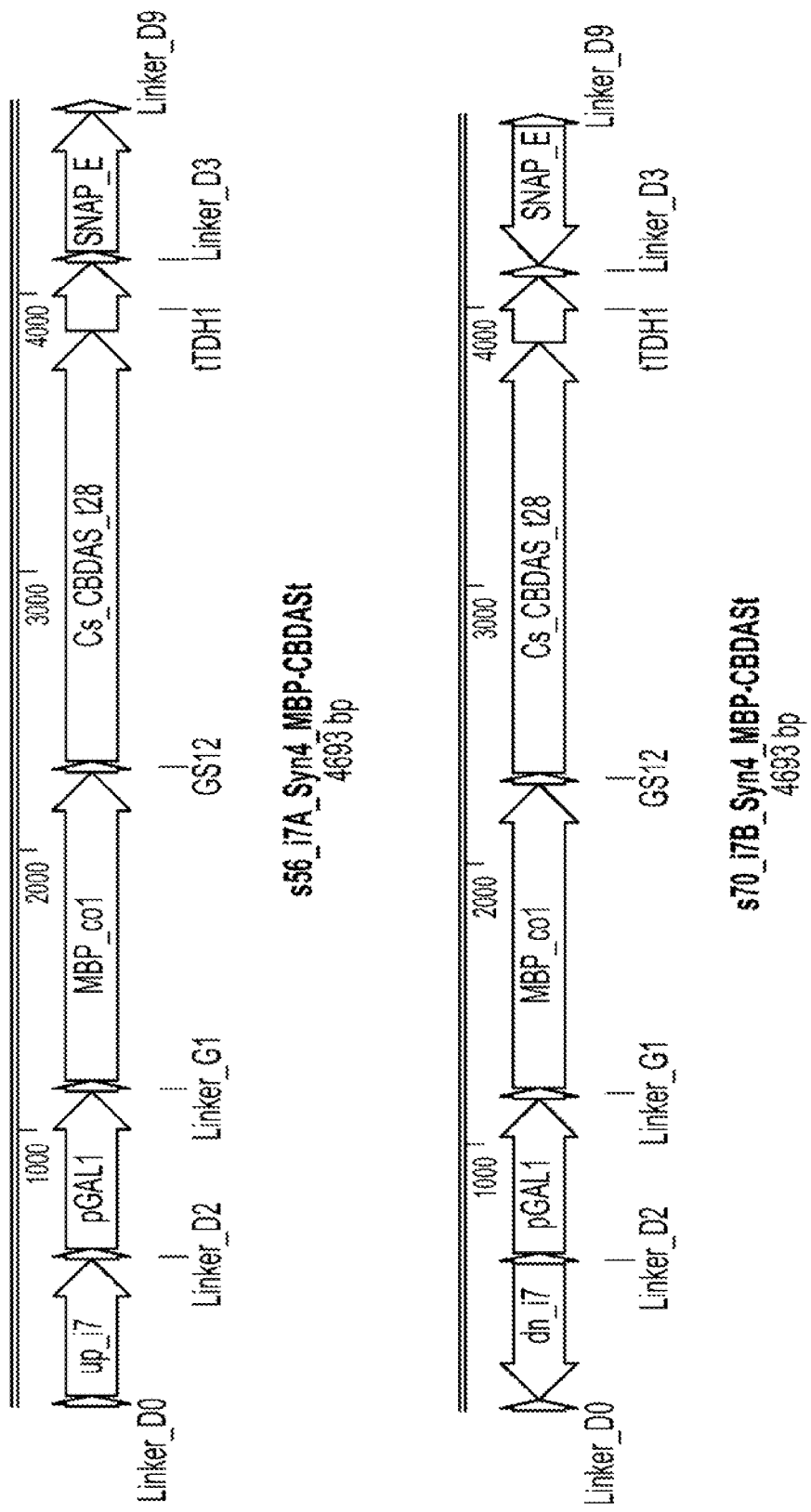
FIG. 32 depicts expression constructs used in the production of the S37 strain.
Figure 33:
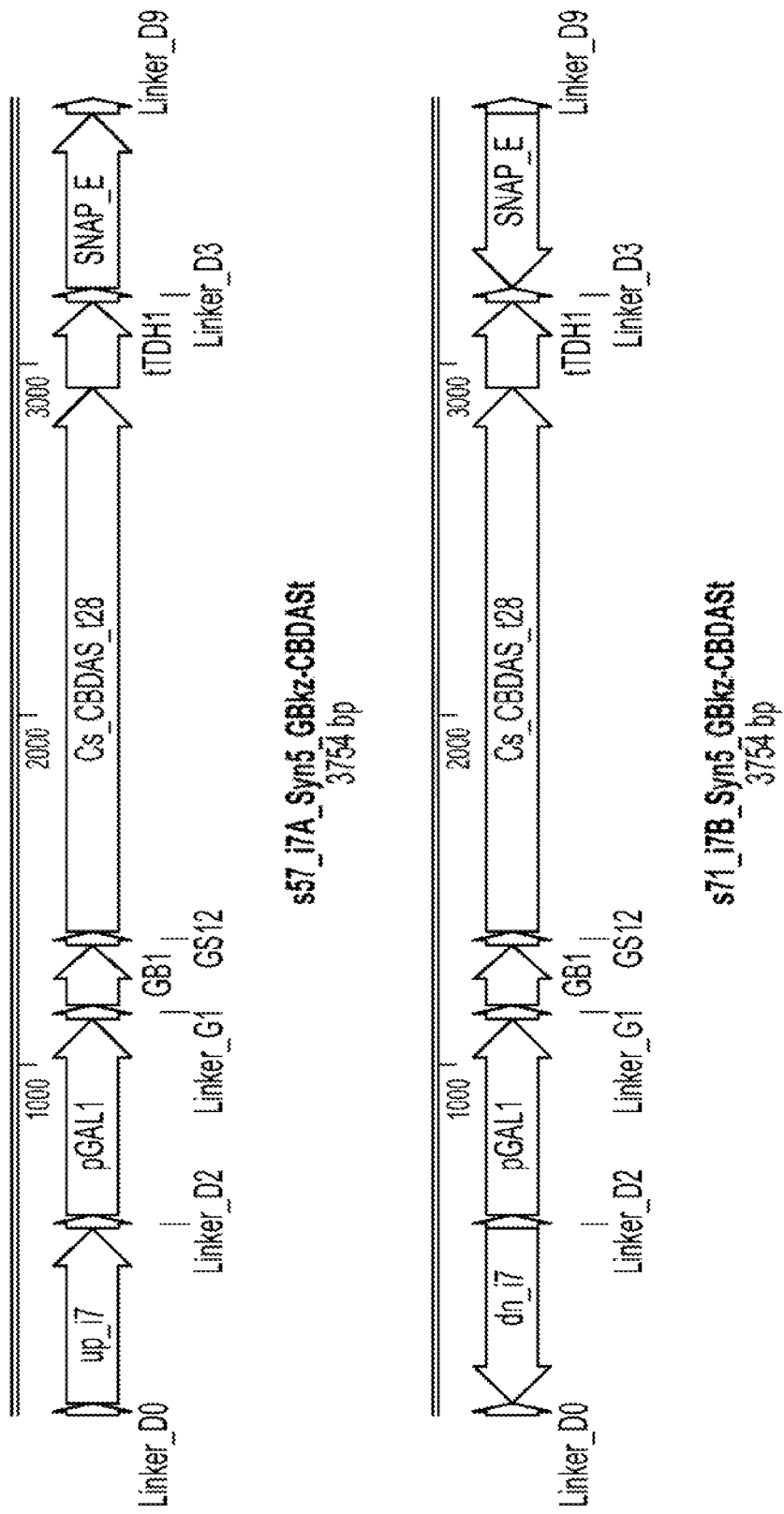
FIG. 33 depicts expression constructs used in the production of the S38 strain.
Figure 34:
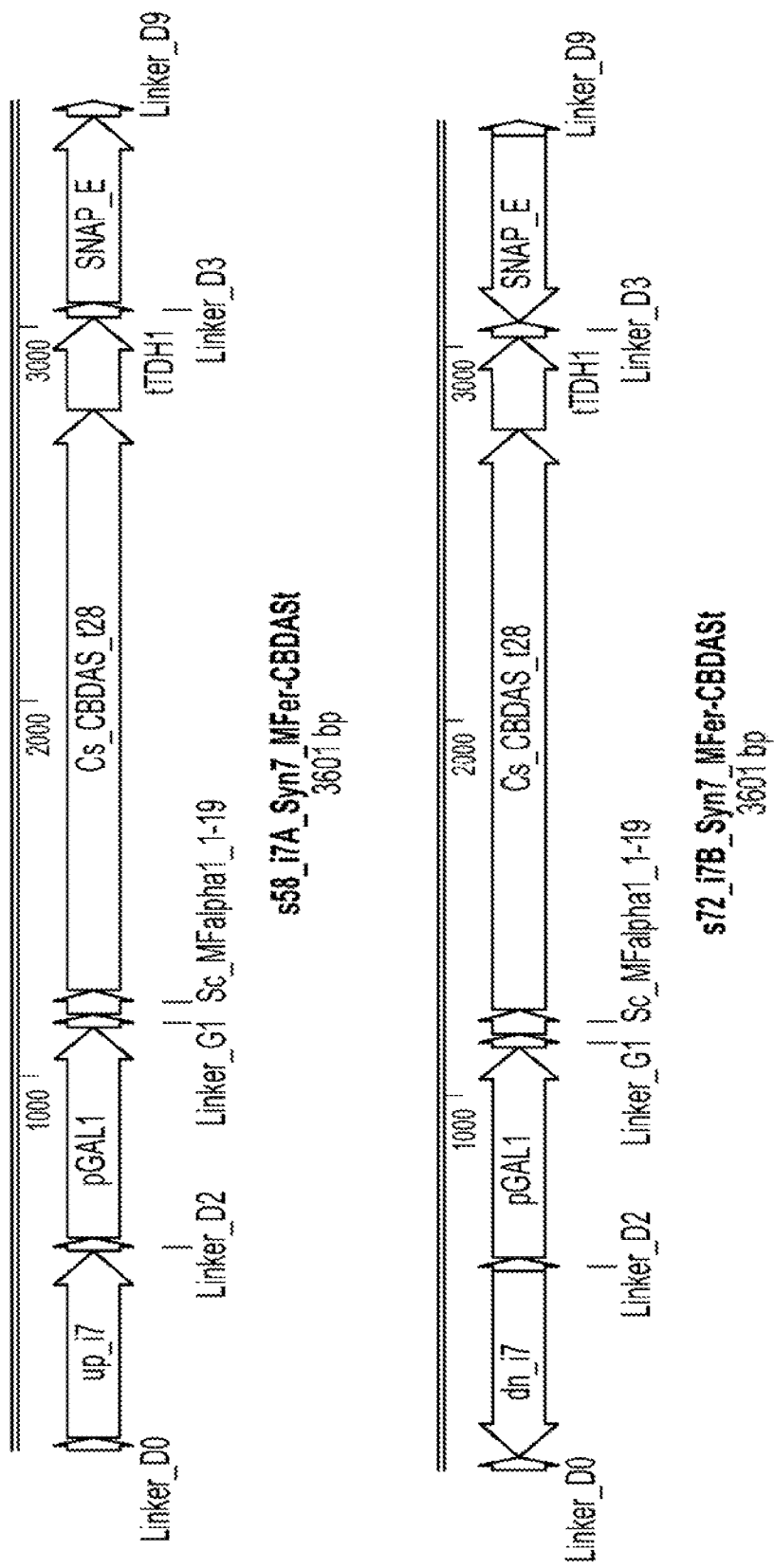
FIG. 34 depicts expression constructs used in the production of the S39 strain.
Figure 35:
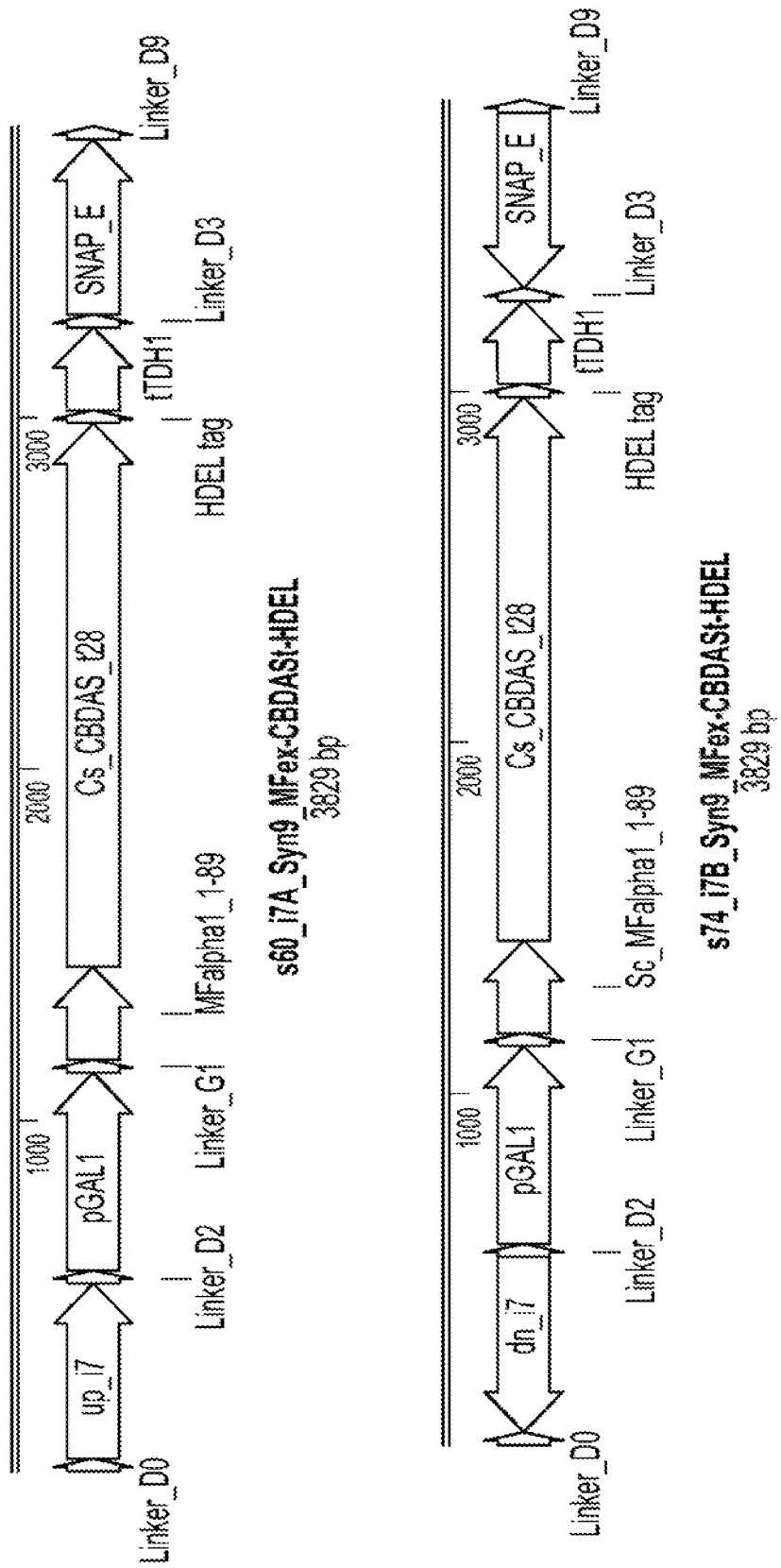
FIG. 35 depicts expression constructs used in the production of the S41 strain.
Figure 36:
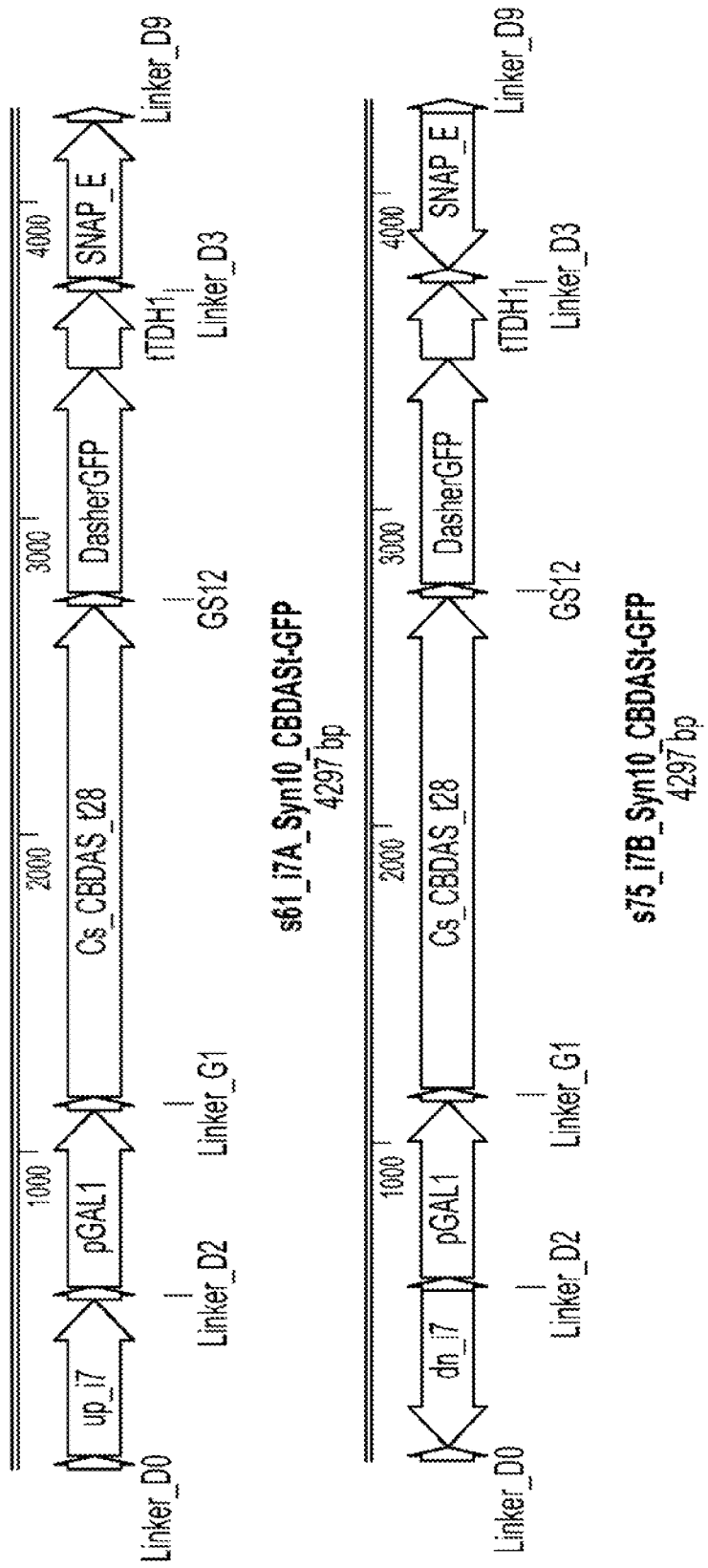
FIG. 36 depicts expression constructs used in the production of the S42 strain.
Figure 37:
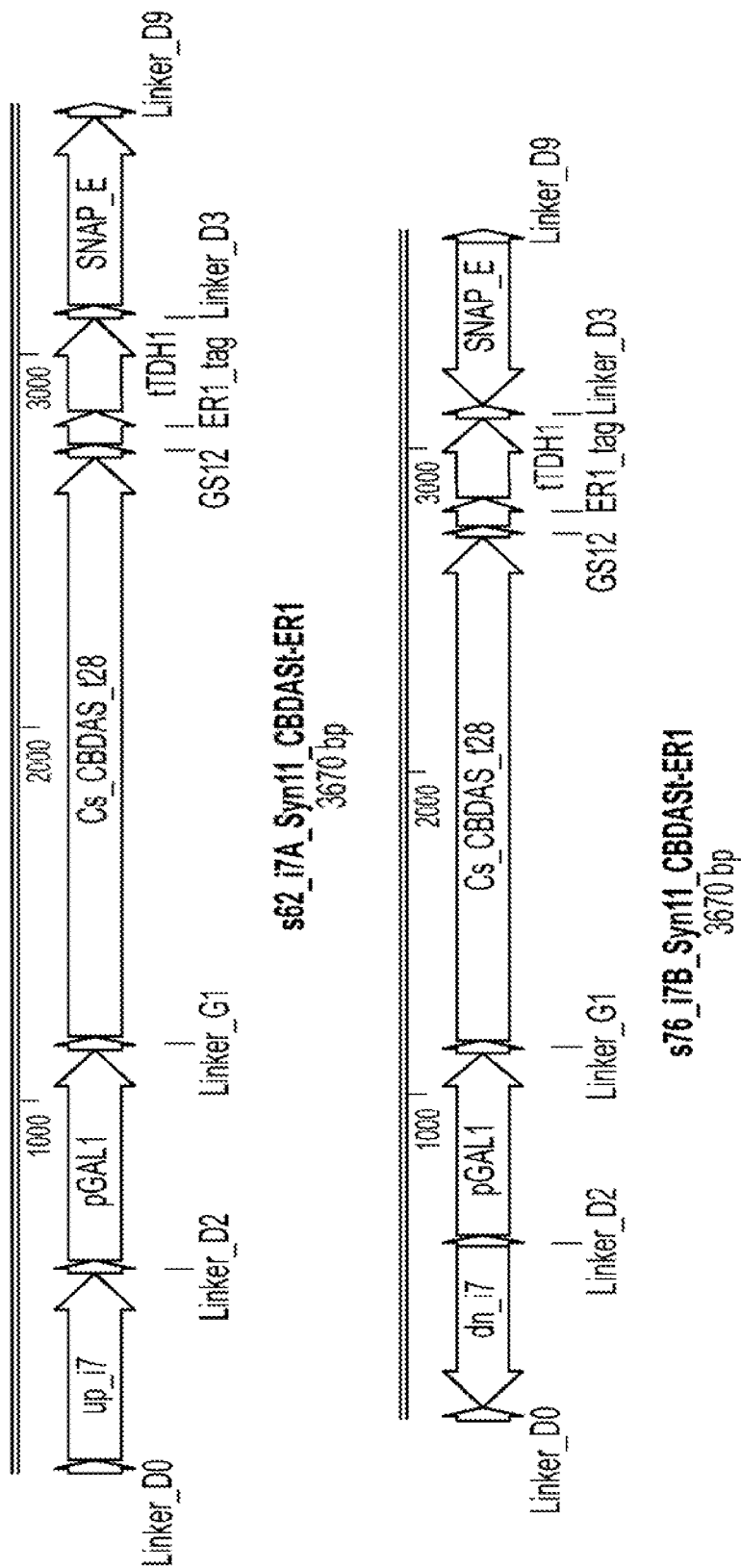
FIG. 37 depicts expression constructs used in the production of the S43 strain.
Figure 38:
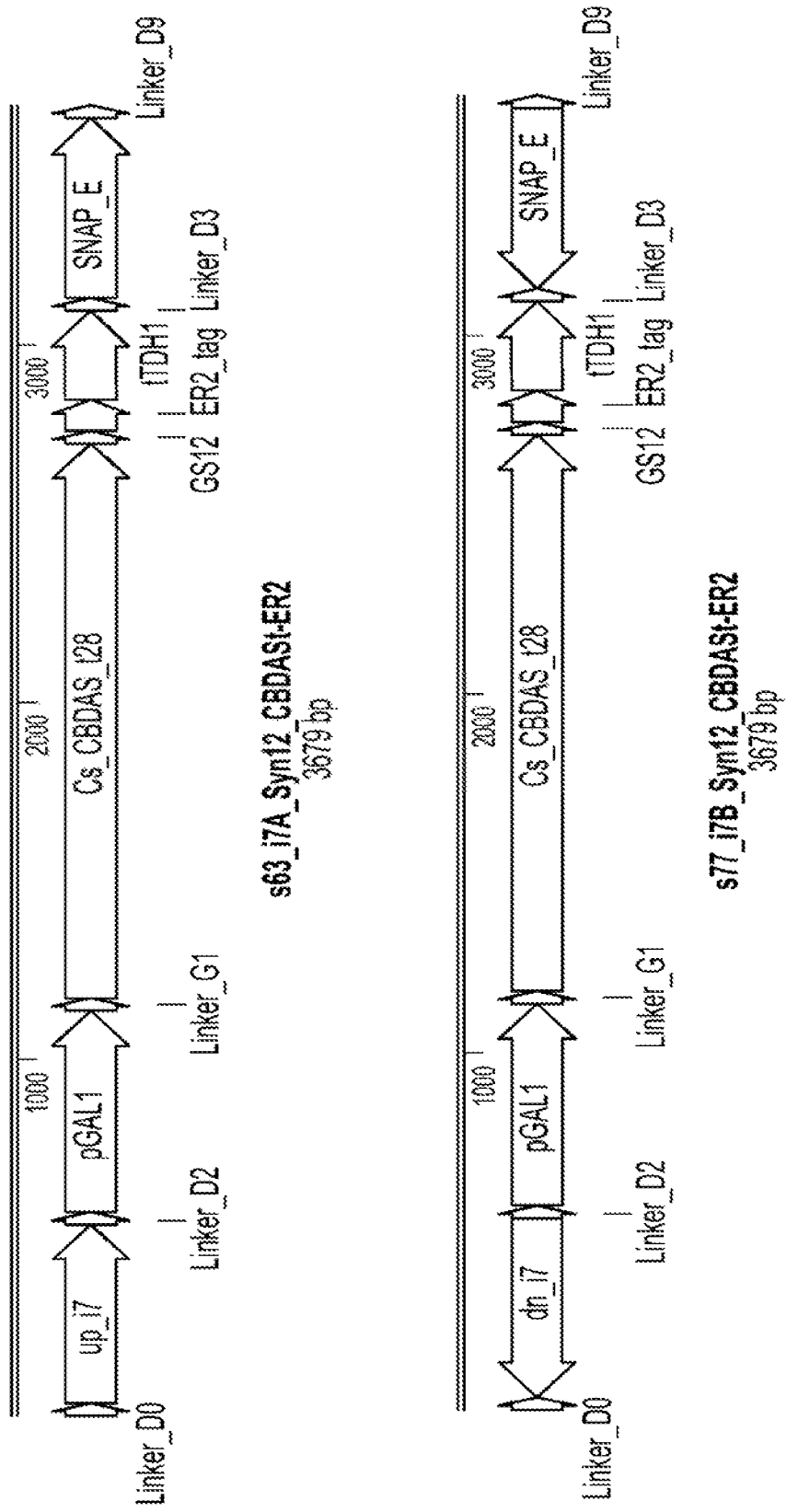
FIG. 38 depicts expression constructs used in the production of the S44 strain.
Figure 39:
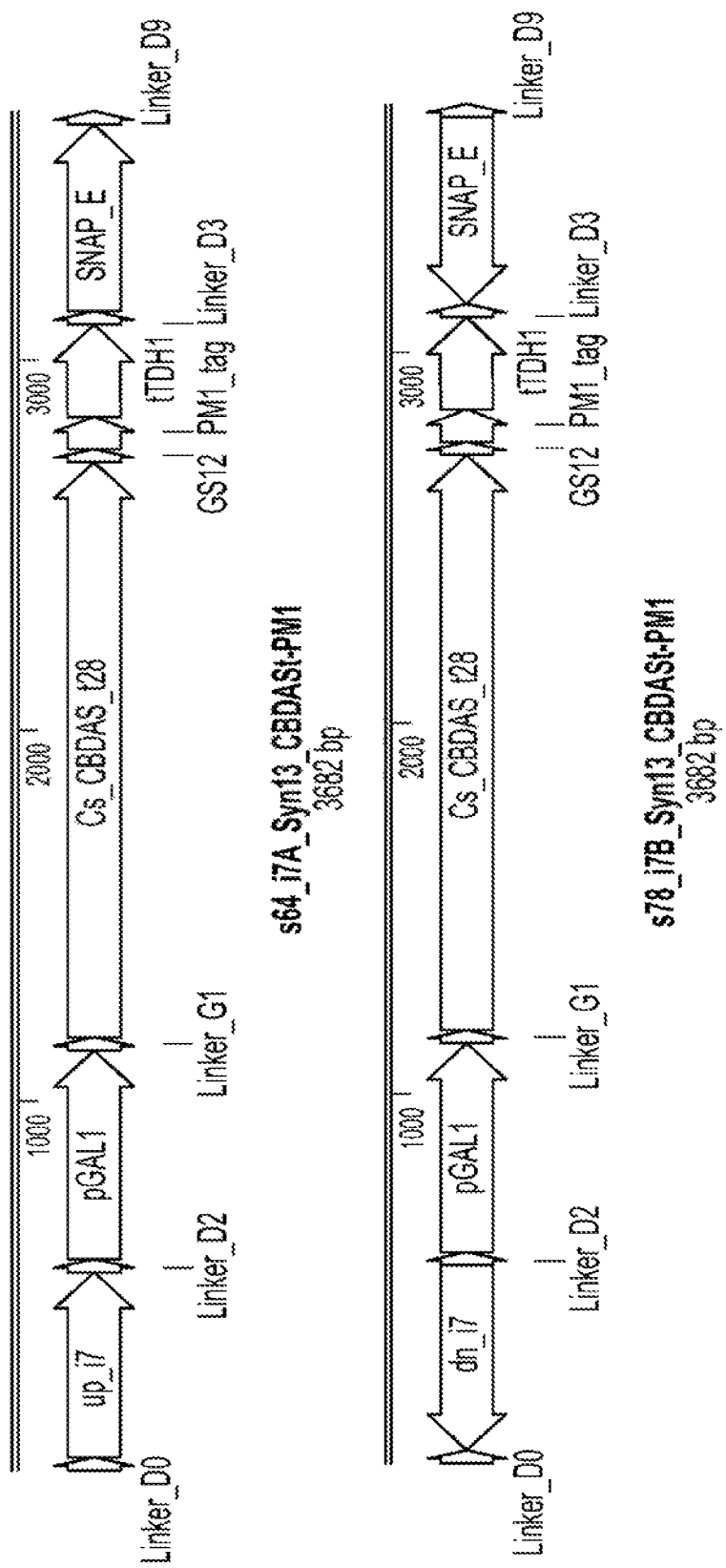
FIG. 39 depicts expression constructs used in the production of the S45 strain.
Figure 40:
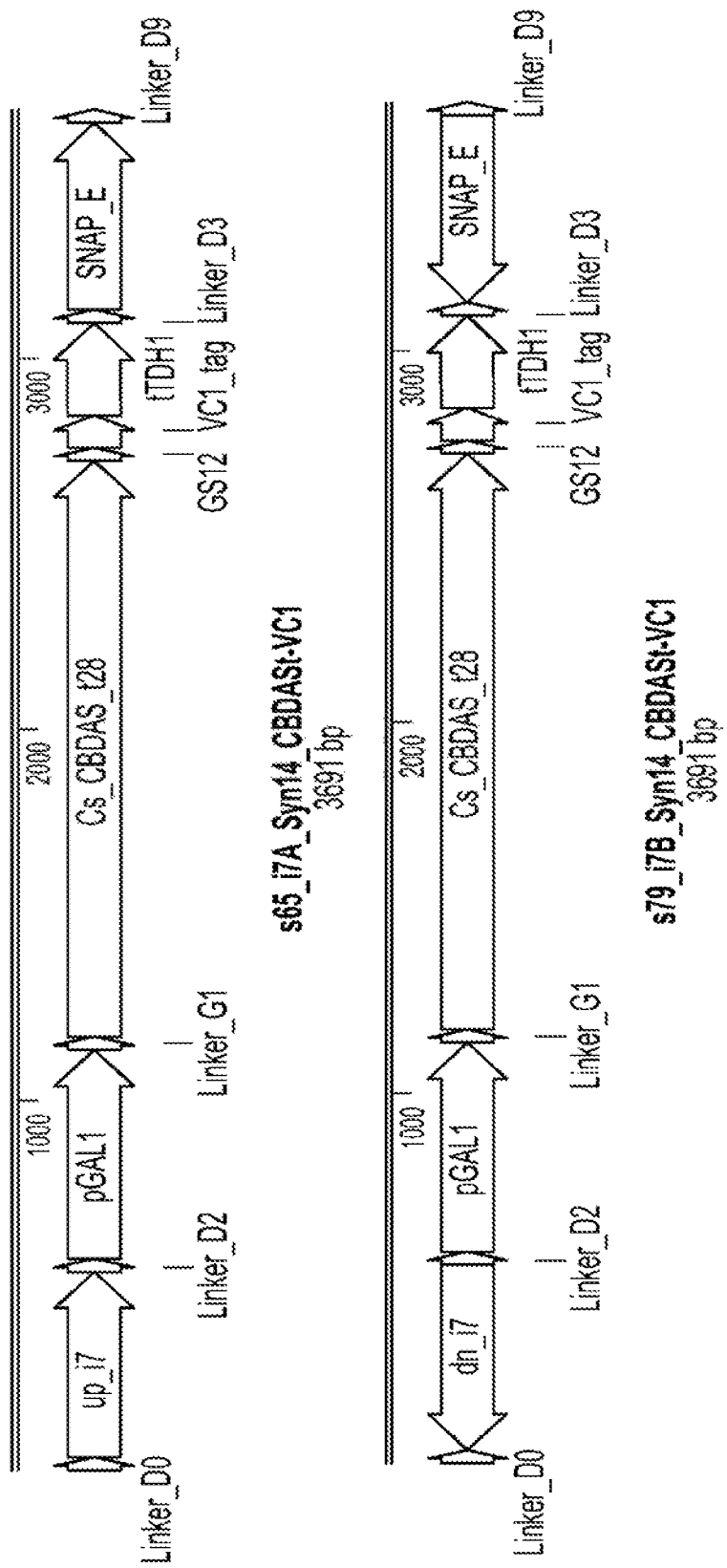
FIG. 40 depicts expression constructs used in the production of the S46 strain.
Figure 41:
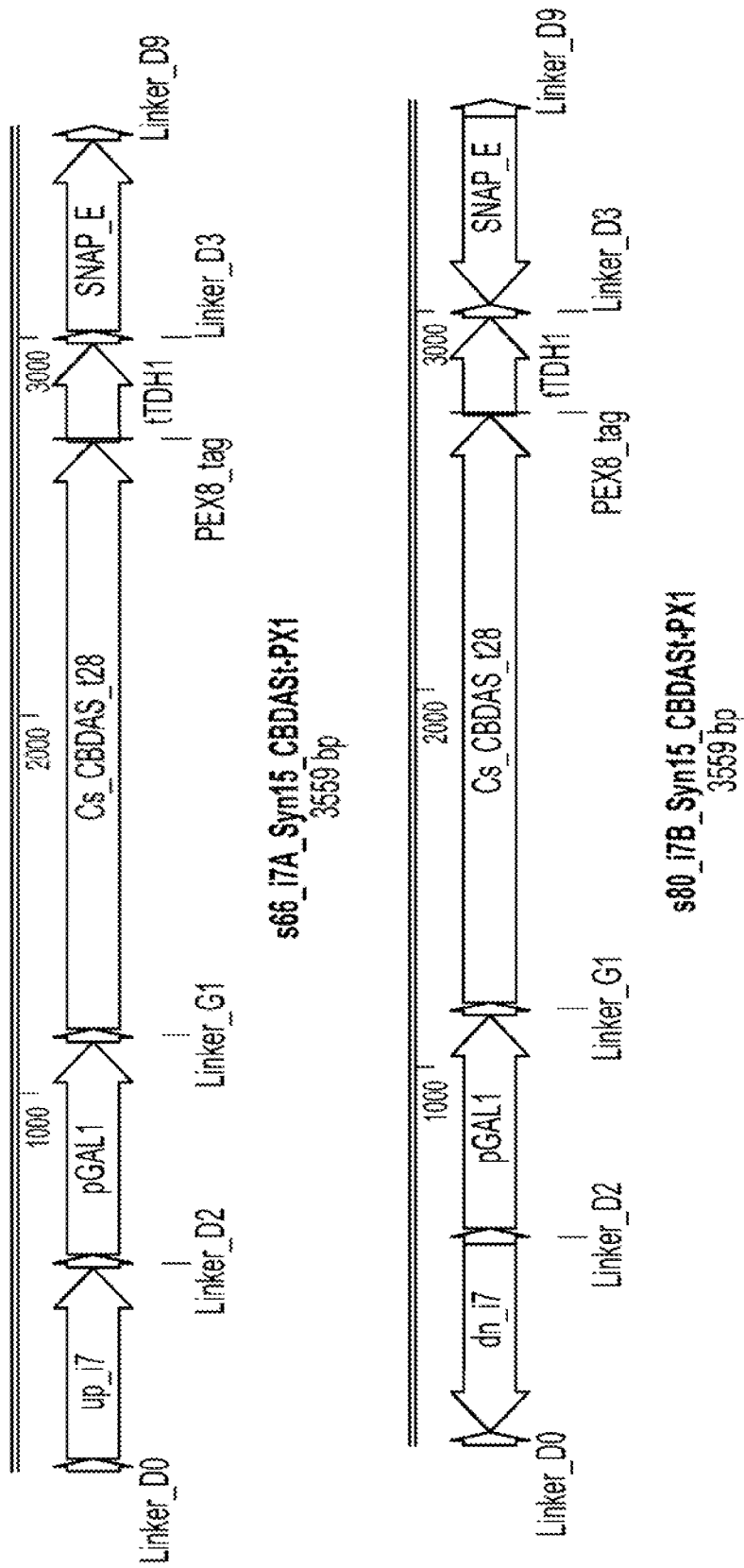
FIG. 41 depicts expression constructs used in the production of the S47 strain.
Figure 42A:
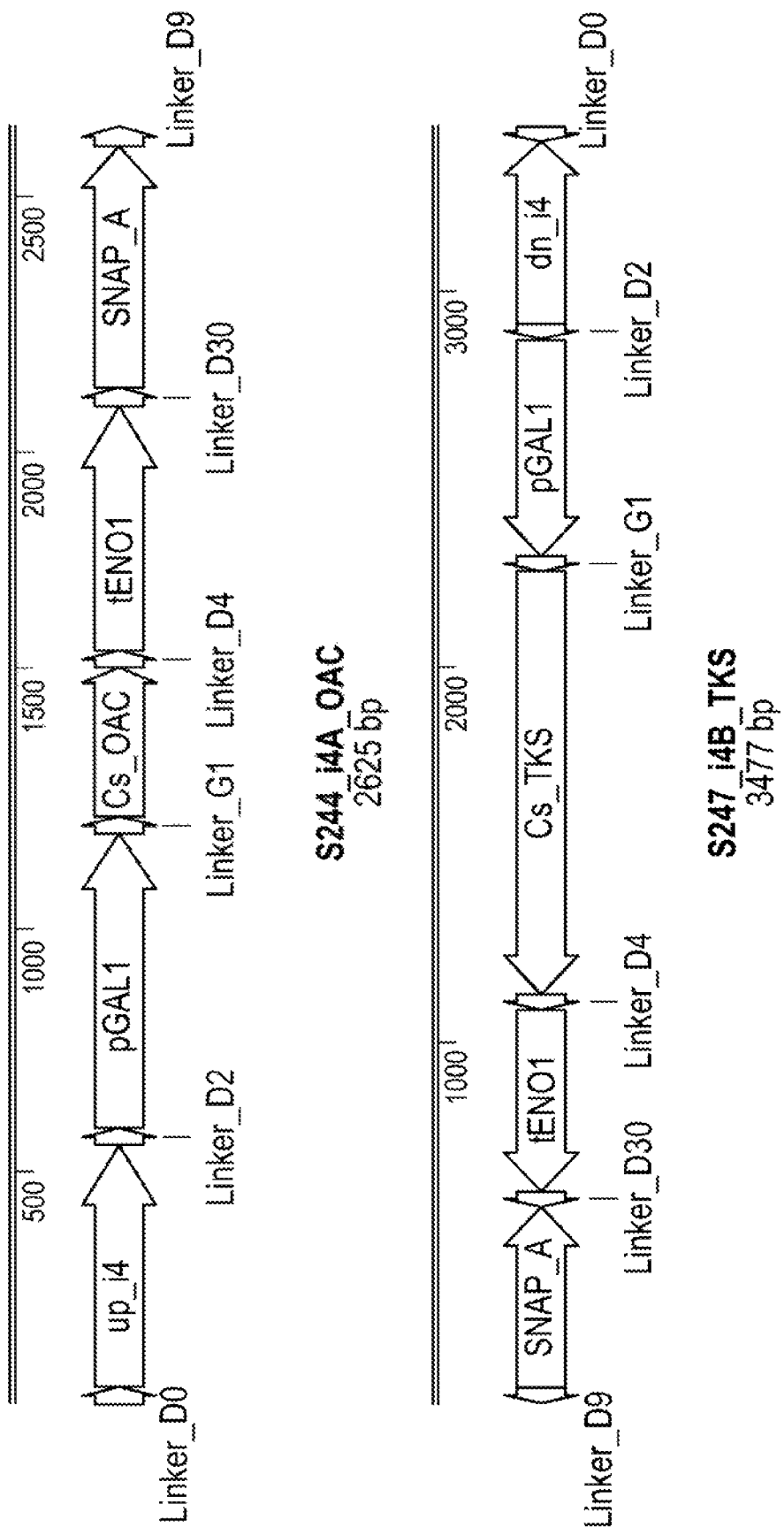
FIGS. 42A, 42B, and 42C depict expression constructs used in the production of the S49 strain.
Figure 42B:
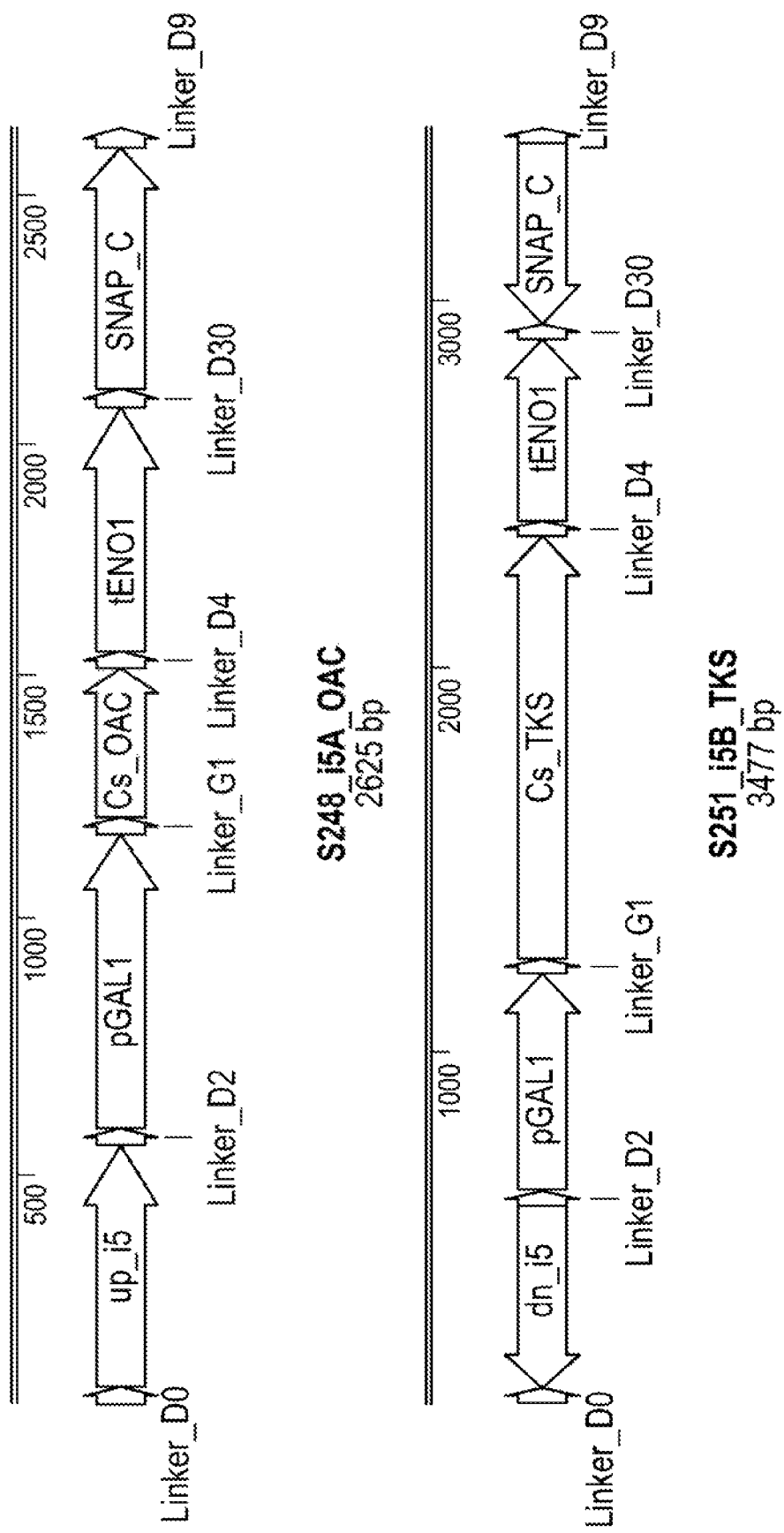
Figure 42C:
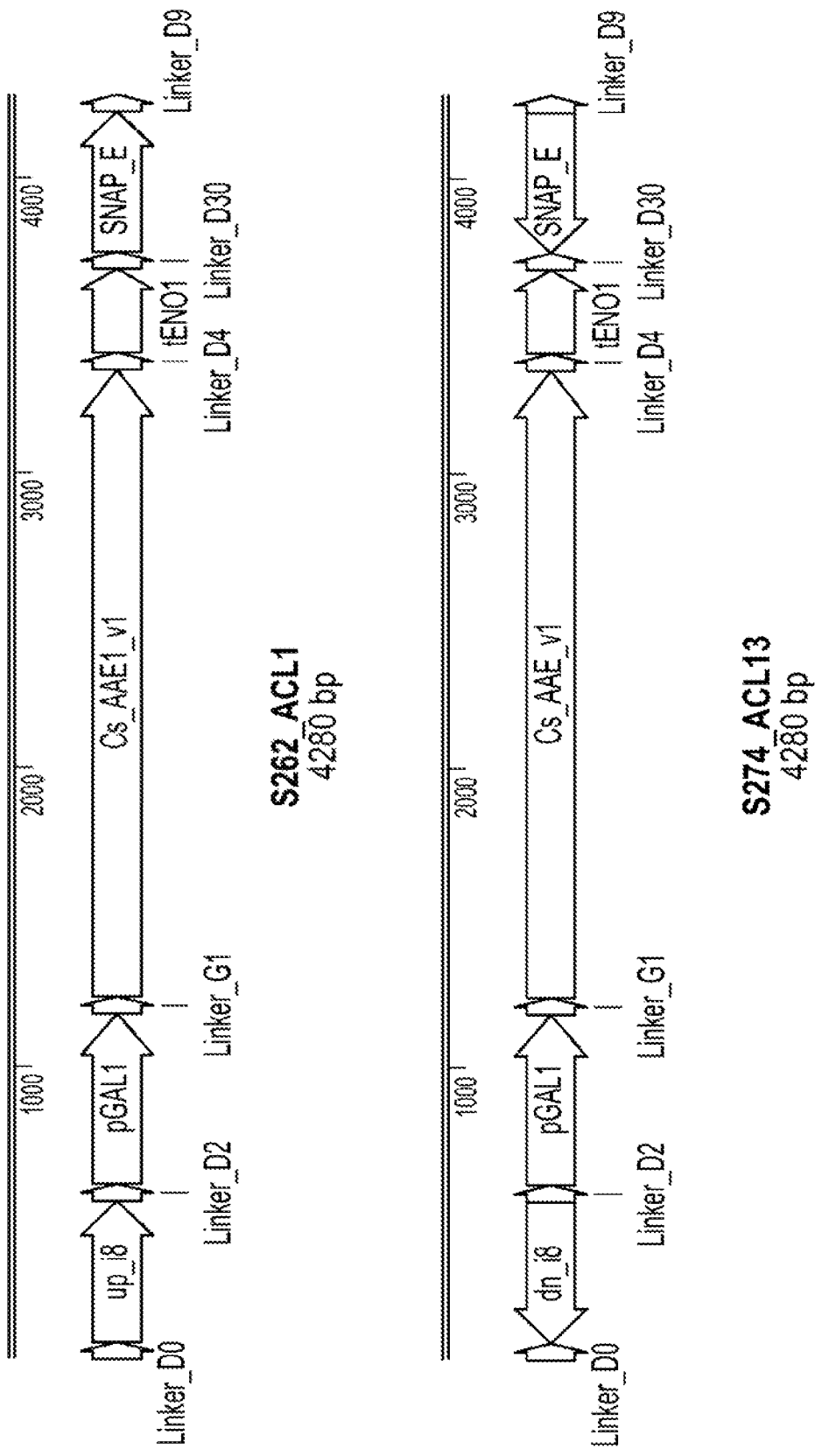
Figure 85:
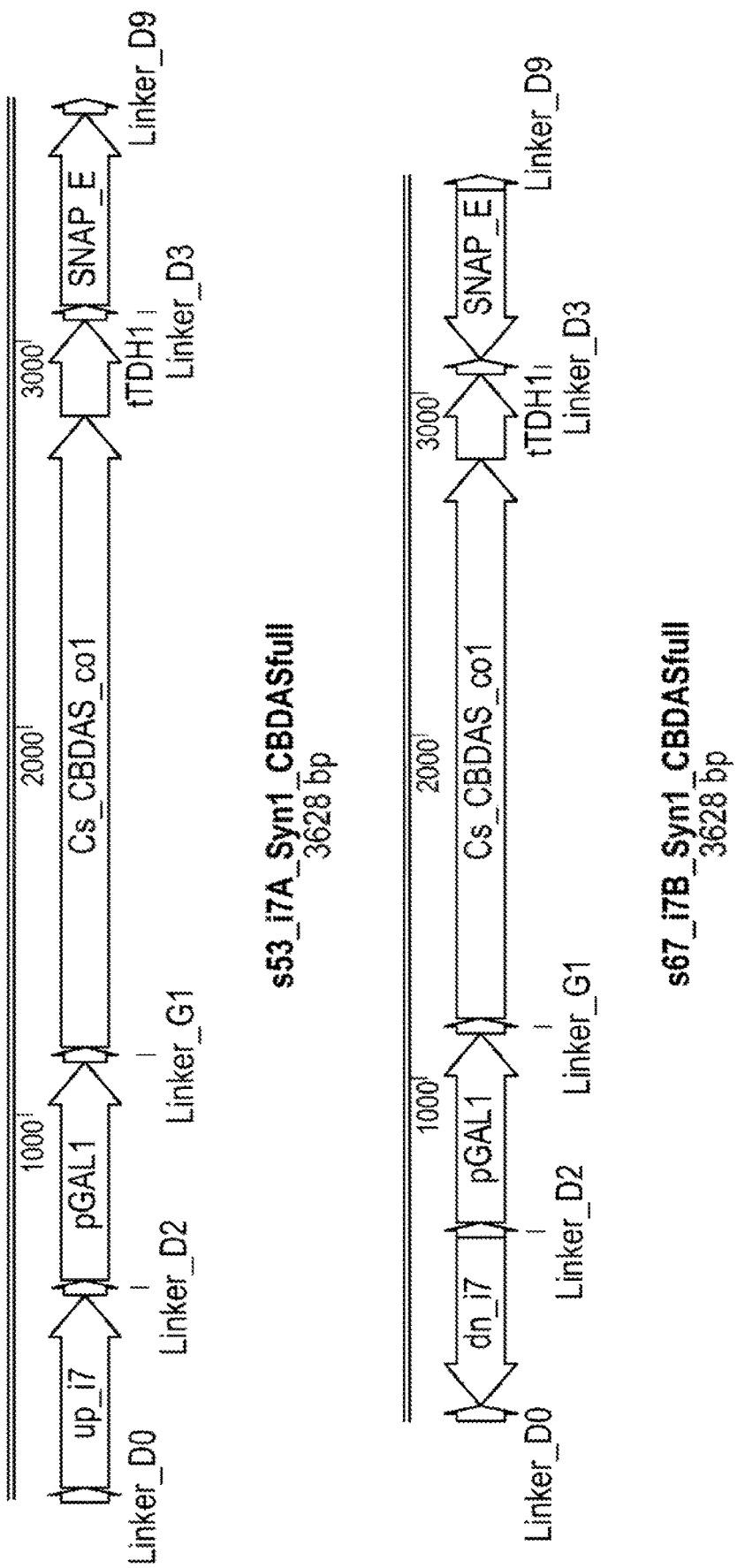
FIG. 85 depicts expression constructs used in the production of the S34 strain.
Figure 86:
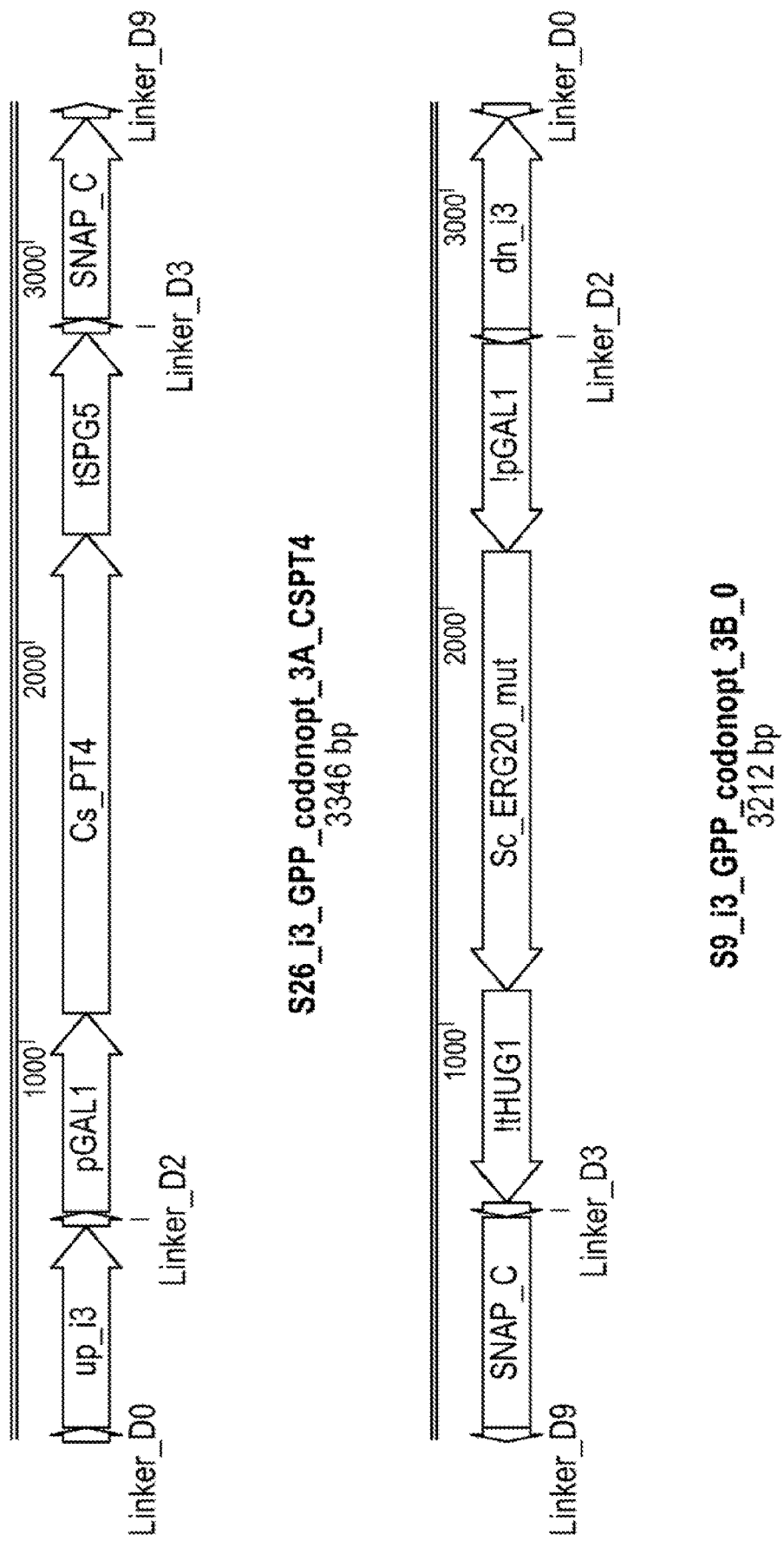
FIG. 86 depicts expression constructs used in the production of the S29 strain. The expression constructs depicted in FIG. 86 are also used in the production of following strains: S31, S34, S35, S37, S38, S39, S41, S42, S43, S44, S45, S46, S47, S49, S50, S51, S78, S80, S81, S82, S83, S84, S85, S86, S87, S88, S89, S90, S91, S94, S95, S97, and S123.

| Strain (Constructs) | Parent Strain* | Polypeptide SEQ ID NOs (Nucleotide SEQ ID NOs) |
|---|---|---|
| S21 (FIGS. 29A and 29B) | | Sc_tHMG1: SEQ ID NO: 208 (SEQ ID NO: 119)<br>Sc_ERG13: SEQ ID NO: 115 (SEQ ID NO: 120)<br>Sc_ERG10: SEQ ID NO: 25 (SEQ ID NO: 209)<br>Sc_MVD1 (Sc_ERG19): SEQ ID NO: 66 (SEQ ID NO: 65)<br>Sc_IDI1: SEQ ID NO: 58 (SEQ ID NO: 57)<br>Zm_PDC: SEQ ID NO: 117 (SEQ ID NO: 118)<br>Sc_ERG8: SEQ ID NO: 205 (SEQ ID NO: 204)<br>Sc_ERG12: SEQ ID NO: 64 (SEQ ID NO: 206) |
| S29 (FIG. 86) | S21 | Cs_PT4: SEQ ID NO: 110 (SEQ ID NO: 111)<br>Sc_ERG20_mut: SEQ ID NO: 60 (SEQ ID NO: 161) |
| S31 (FIGS. 30A, 30B, and 30C) | S29 | Cs_OAC: SEQ ID NO: 10 (SEQ ID NO: 163)<br>Cs_TKS: SEQ ID NO: 11 (SEQ ID NO: 162)<br>Cs_AAE1_v1: SEQ ID NO: 90 (SEQ ID NO: 164)<br>Sc_FAA2: SEQ ID NO: 169 (SEQ ID NO: 168) |
| S34 (FIG. 85) | S29 | Cs_CBDAS_co1: SEQ ID NO: 88 (SEQ ID NO: 167) |
| S35 (FIG. 31) | S29 | Cs_CBDAS_t28: SEQ ID NO: 151 (SEQ ID NO: 152) |
| S37 (FIG. 32) | S29 | MBP_co1: SEQ ID NO: 108 (SEQ ID NO: 170)<br>Cs_CBDAS_t28: SEQ ID NO: 151 (SEQ ID NO: 152)<br>GS12: SEQ ID NO: 172 (SEQ ID NO: 171) |
| S38 (FIG. 33) | S79 | Cs_CBDAS_t28: SEQ ID NO: 151 (SEQ ID NO: 152)<br>GB1: SEQ ID NO: 174 (SEQ ID NO: 173)<br>GS12: SEQ ID NO: 172 (SEQ ID NO: 171) |
| S39 (FIG. 34) | S29 | Cs_CBDAS_t28: SEQ ID NO: 151 (SEQ ID NO: 152)<br>Sc_MFalpha1_1-19: SEQ ID NO: 176 (SEQ ID NO: 175) |
| S41 (FIG. 35) | S79 | Cs_CBDAS_t28: SEQ ID NO: 151 (SEQ ID NO: 152)<br>Sc_MFalpha1_1-89: SEQ ID NO: 178 (SEQ ID NO: 177) |
| S42 (FIG. 36) | S29 | Cs_CBDAS_t28: SEQ ID NO: 151 (SEQ ID NO: 152)<br>DasherGFP: SEQ ID NO: 180 (SEQ ID NO: 179)<br>GS12: SEQ ID NO: 172 (SEQ ID NO: 171) |
| S43 (FIG. 37) | S79 | Cs_CBDAS_t28: SEQ ID NO: 151 (SEQ ID NO: 152)<br>GS12: SEQ ID NO: 172 (SEQ ID NO: 171)<br>ER1_tag: SEQ ID NO: 182 (SEQ ID NO: 181) |
| S44 (FIG. 38) | S29 | Cs_CBDAS_t28: SEQ ID NO: 151 (SEQ ID NO: 152)<br>GS12: SEQ ID NO: 172 (SEQ ID NO: 171)<br>ER2_tag: SEQ ID NO: 184 (SEQ ID NO: 183) |
| S45 (FIG. 39) | S29 | Cs_CBDAS_t28: SEQ ID NO: 151 (SEQ ID NO: 152)<br>GS12: SEQ ID NO: 172 (SEQ ID NO: 171)<br>PM1_tag: SEQ ID NO: 186 (SEQ ID NO: 185) |
| S46 (FIG. 40) | S29 | Cs_CBDAS_t28: SEQ ID NO: 151 (SEQ ID NO: 152)<br>GS12: SEQ ID NO: 172 (SEQ ID NO: 171)<br>VC1_tag: SEQ ID NO: 188 (SEQ ID NO: 187) |
| S47 (FIG. 41) | S29 | Cs_CBDAS_t28: SEQ ID NO: 151 (SEQ ID NO: 152)<br>PEX8_tag: SEQ ID NO: 190 (SEQ ID NO: 189) |
| S49 (FIGS. 42A, 42B, and 42C) | S29 | Cs_OAC: SEQ ID NO: 10 (SEQ ID NO: 163)<br>Cs_TKS: SEQ ID NO: 11 (SEQ ID NO: 162)<br>Cs_AAE1_v1: SEQ ID NO: 90 (SEQ ID NO: 164)<br>Cs_AAE_v1: SEQ ID NO: 90 (SEQ ID NO: 164) |

TABLE 11-continued

Constructs and strains used in the Examples

Figure 43A:
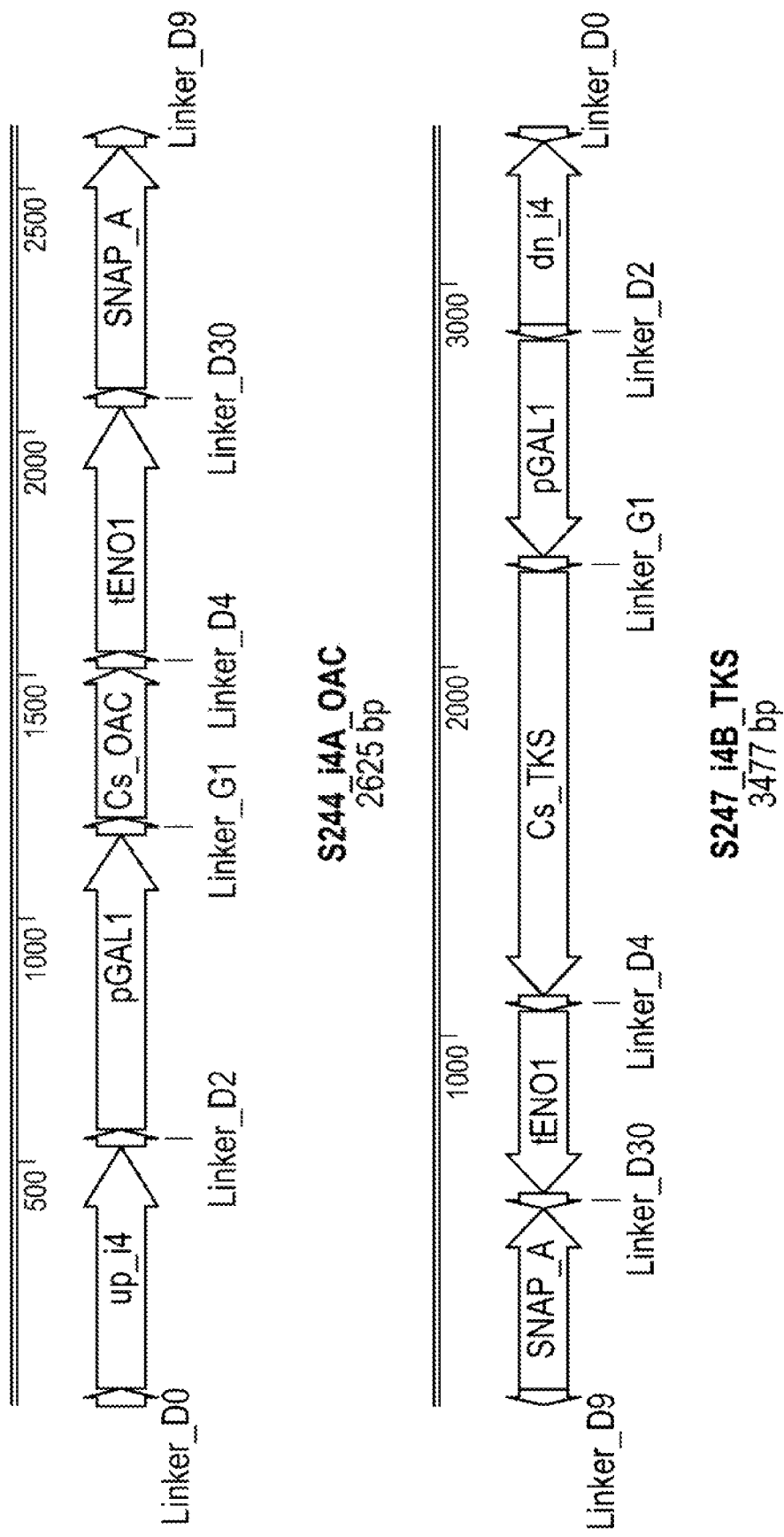
FIGS. 43A, 43B, and 43C depict expression constructs used in the production of the S50 strain.
Figure 43B:
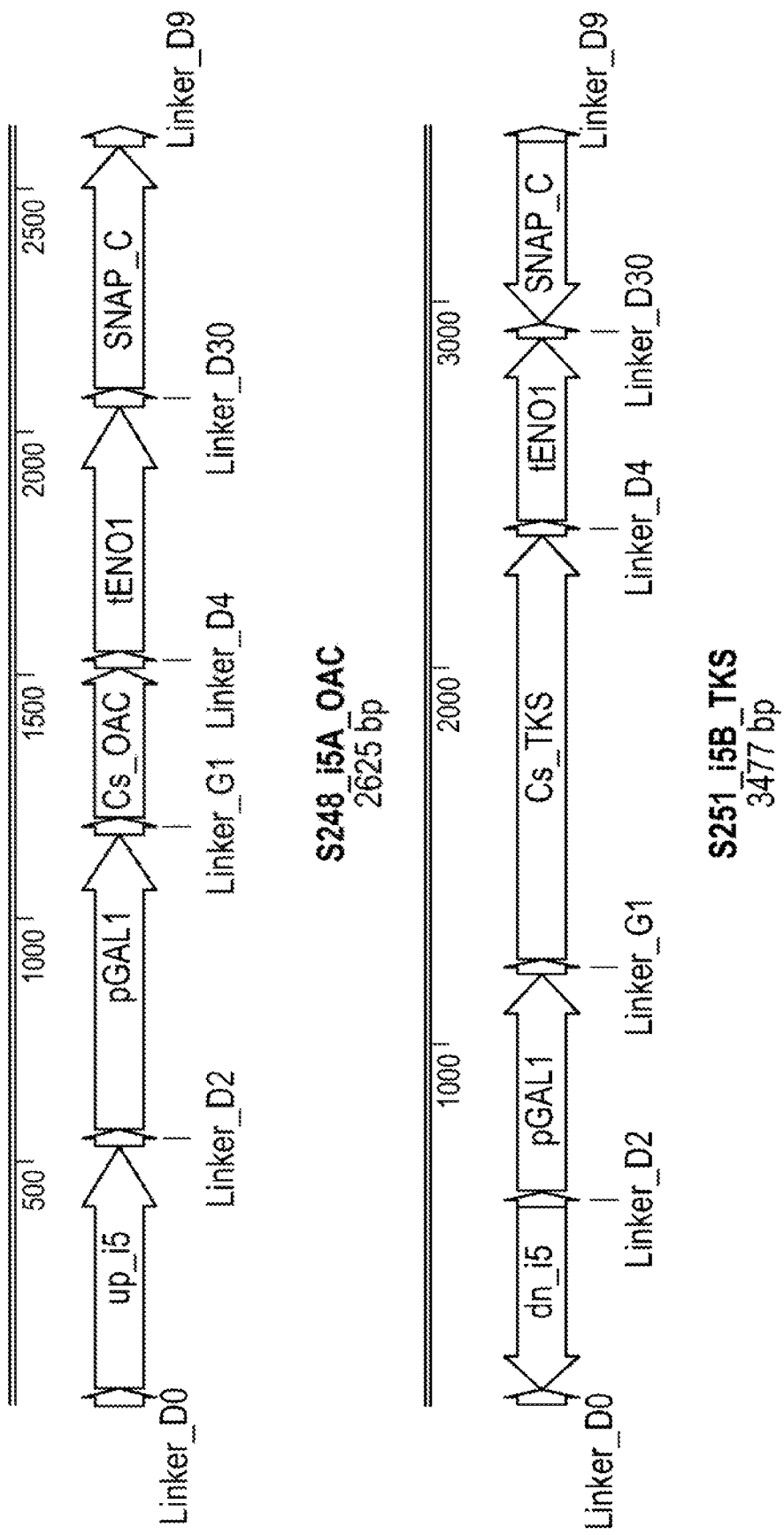
Figure 43C:
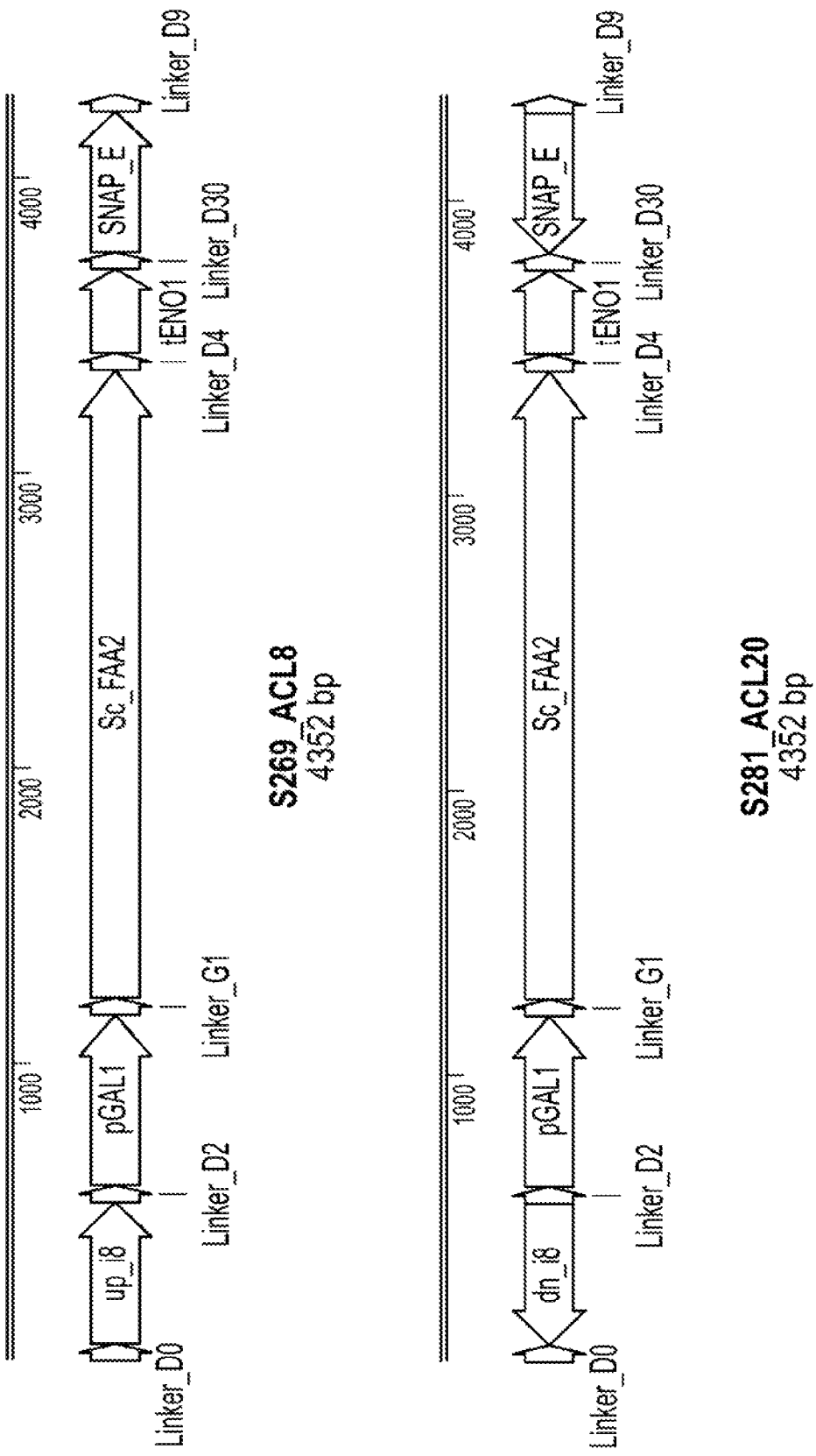
Figure 44A:
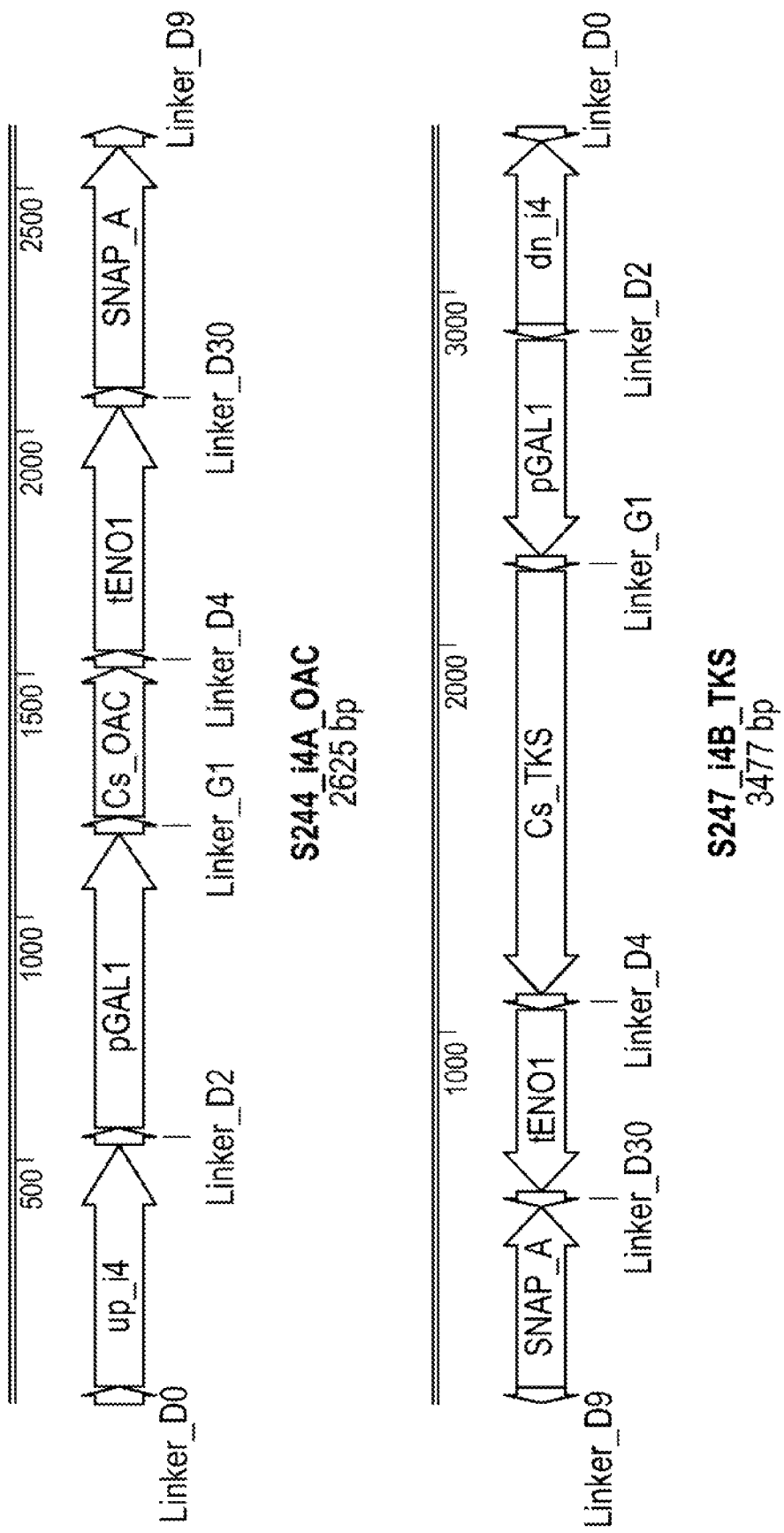
FIGS. 44A, 44B, and 44C depict expression constructs used in the production of the S51 strain. The expression constructs depicted in FIGS. 44A, 44B, and 44C are also used in the production of following strains: S78, S80, S81, S82, S83, S84, S85, S86, S87, S88, and S89.
Figure 44B:
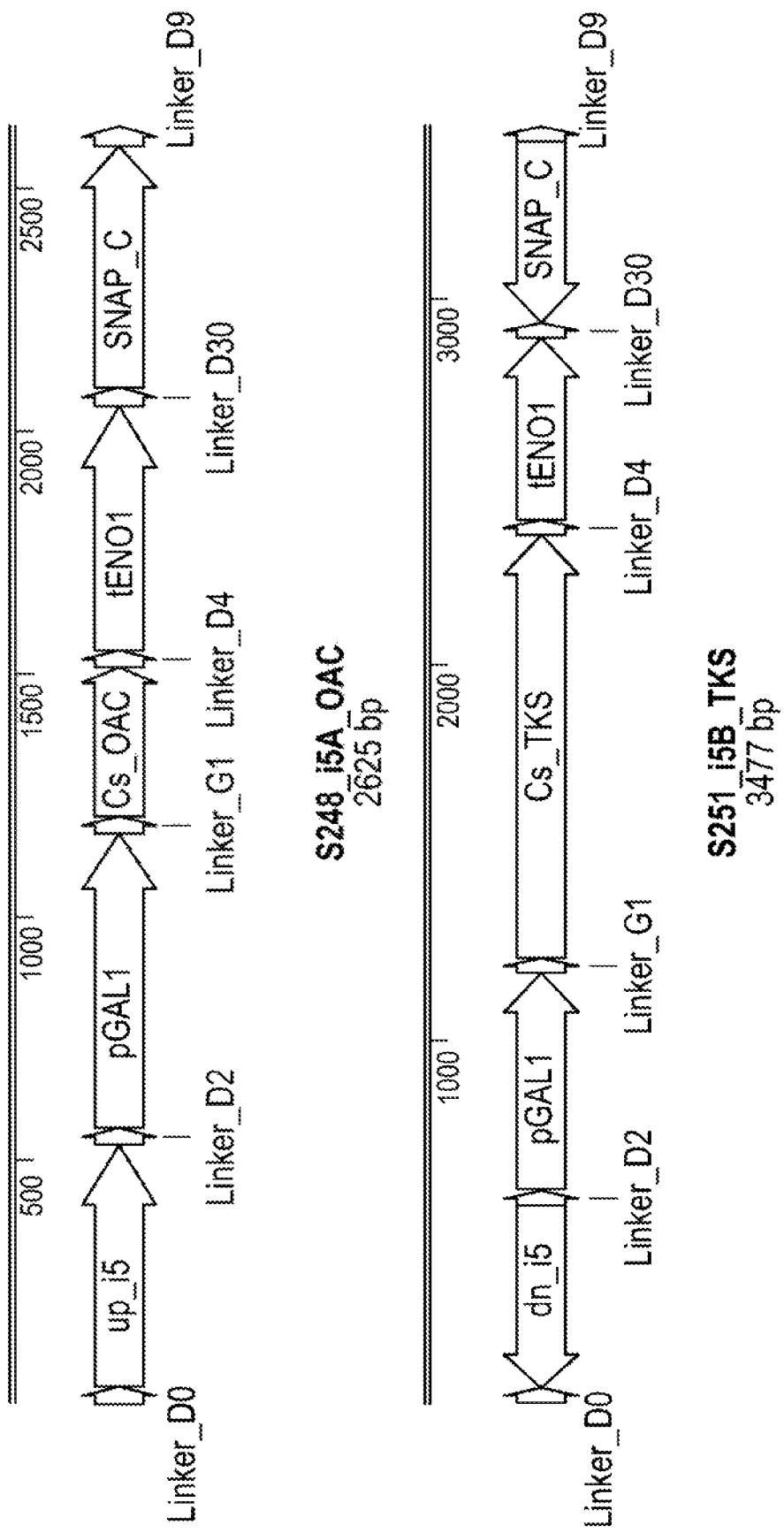
Figure 44C:
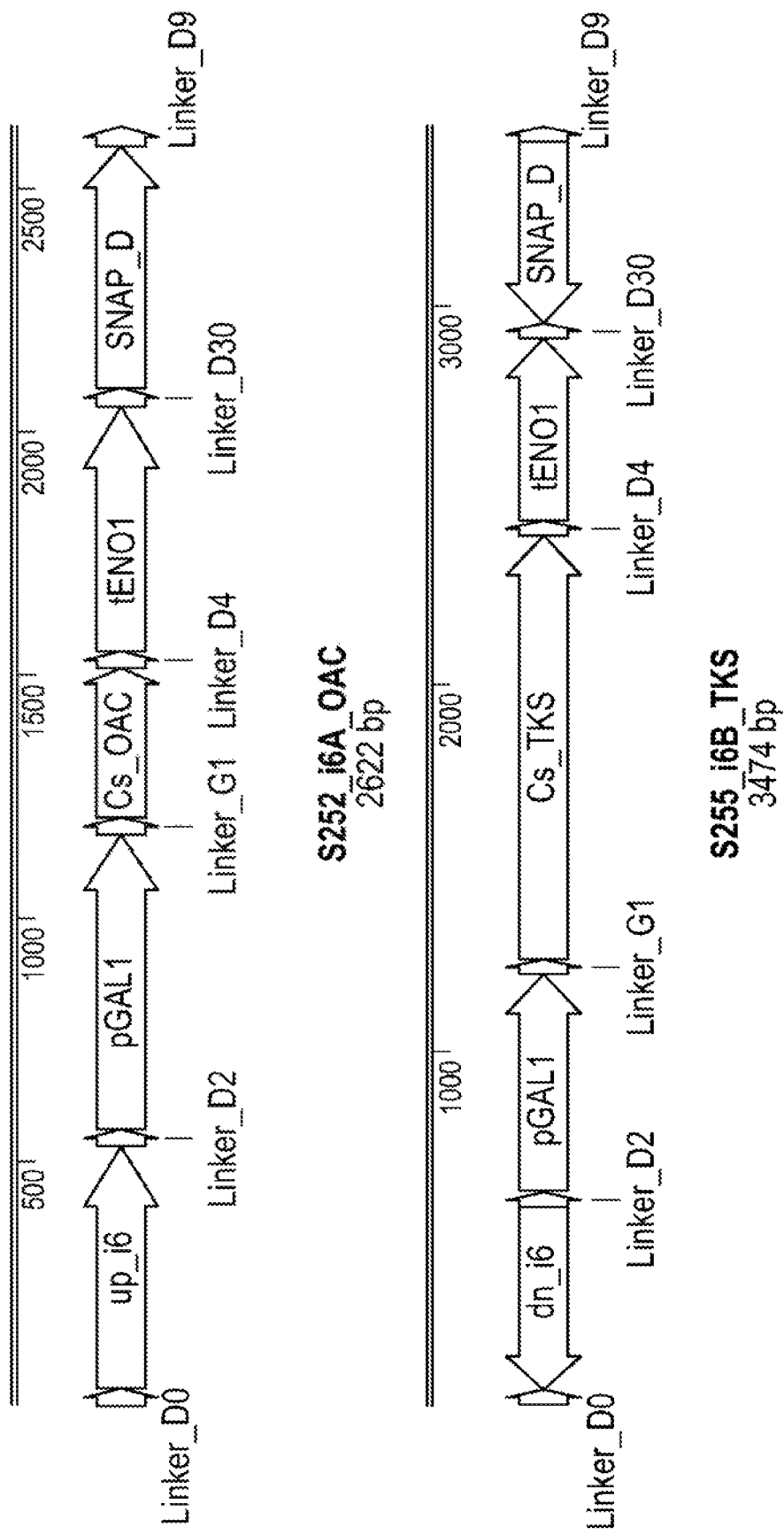
Figure 45:
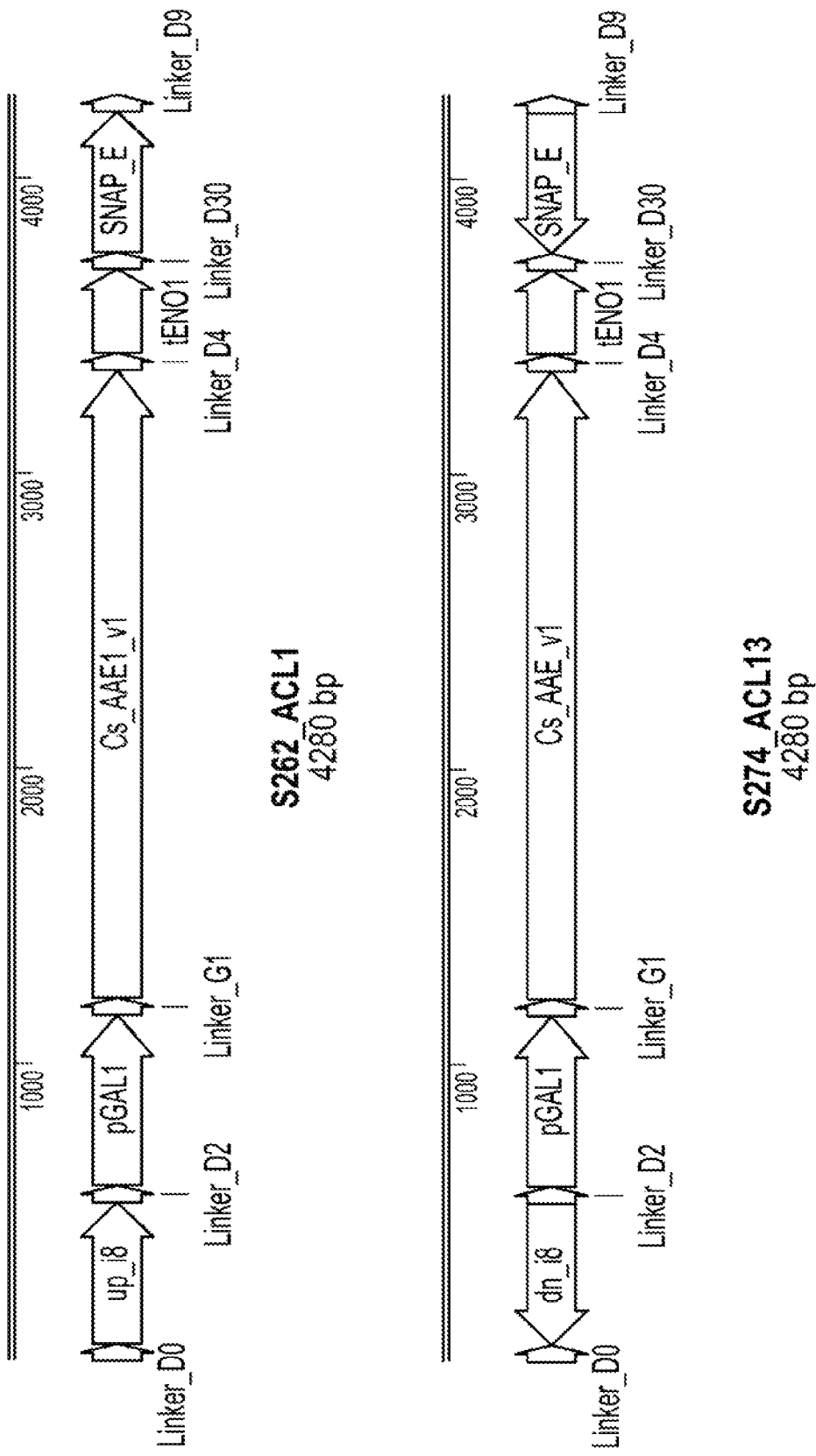
FIG. 45 depicts expression constructs used in the production of the S78 strain.
Figure 46:
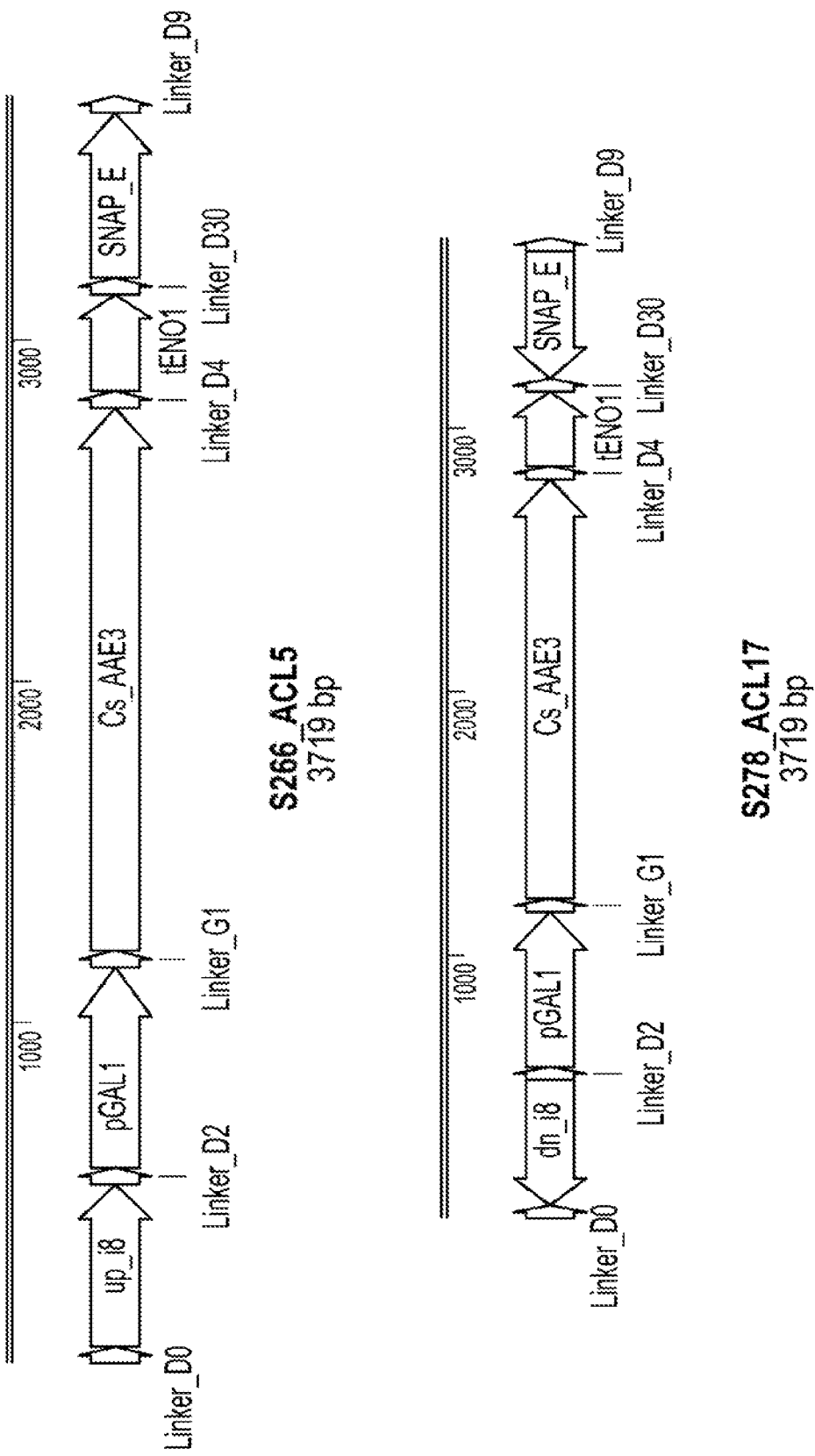
FIG. 46 depicts expression constructs used in the production of the S80 strain.
Figure 47:
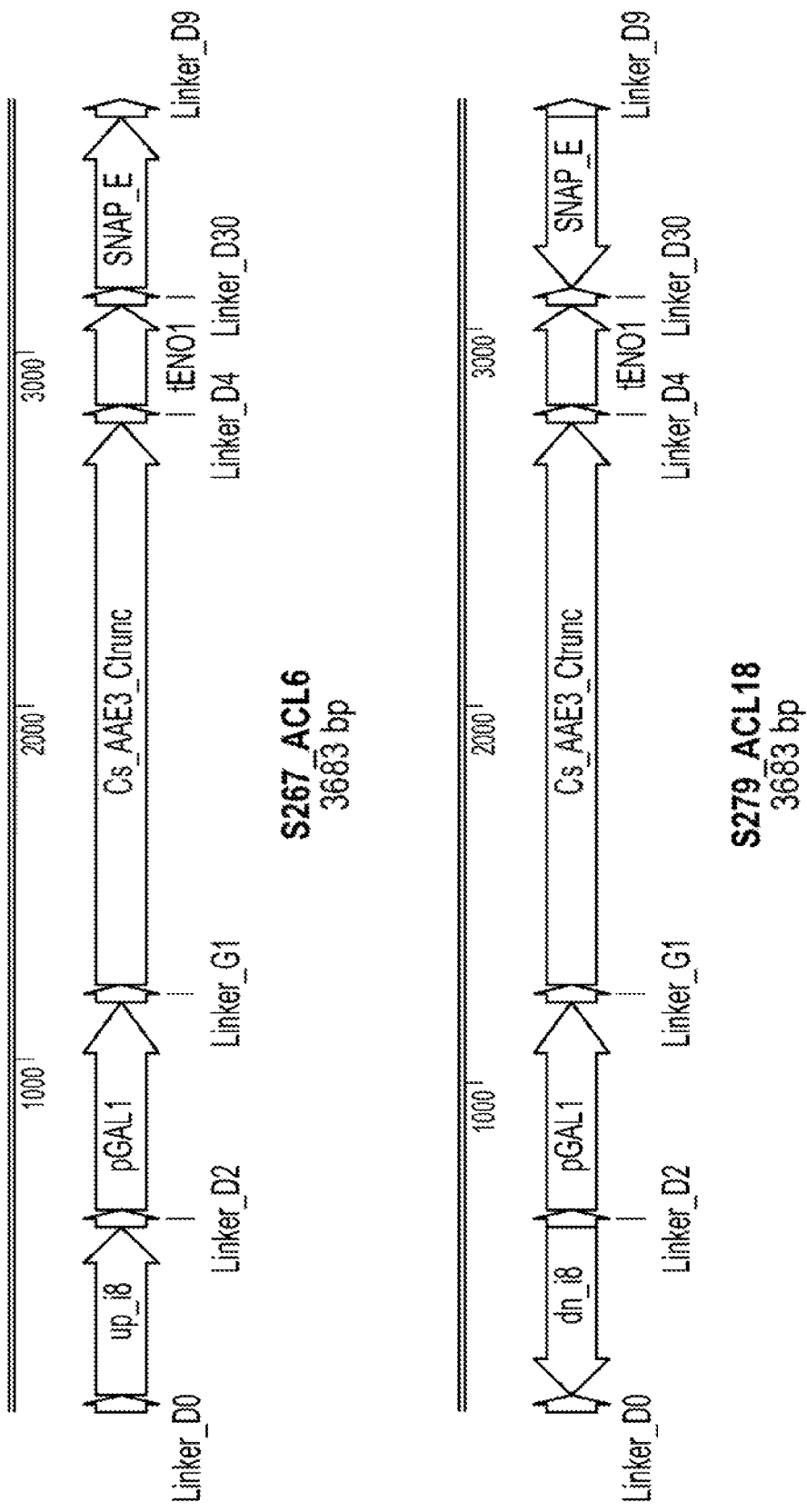
FIG. 47 depicts expression constructs used in the production of the S81 strain.
Figure 48:
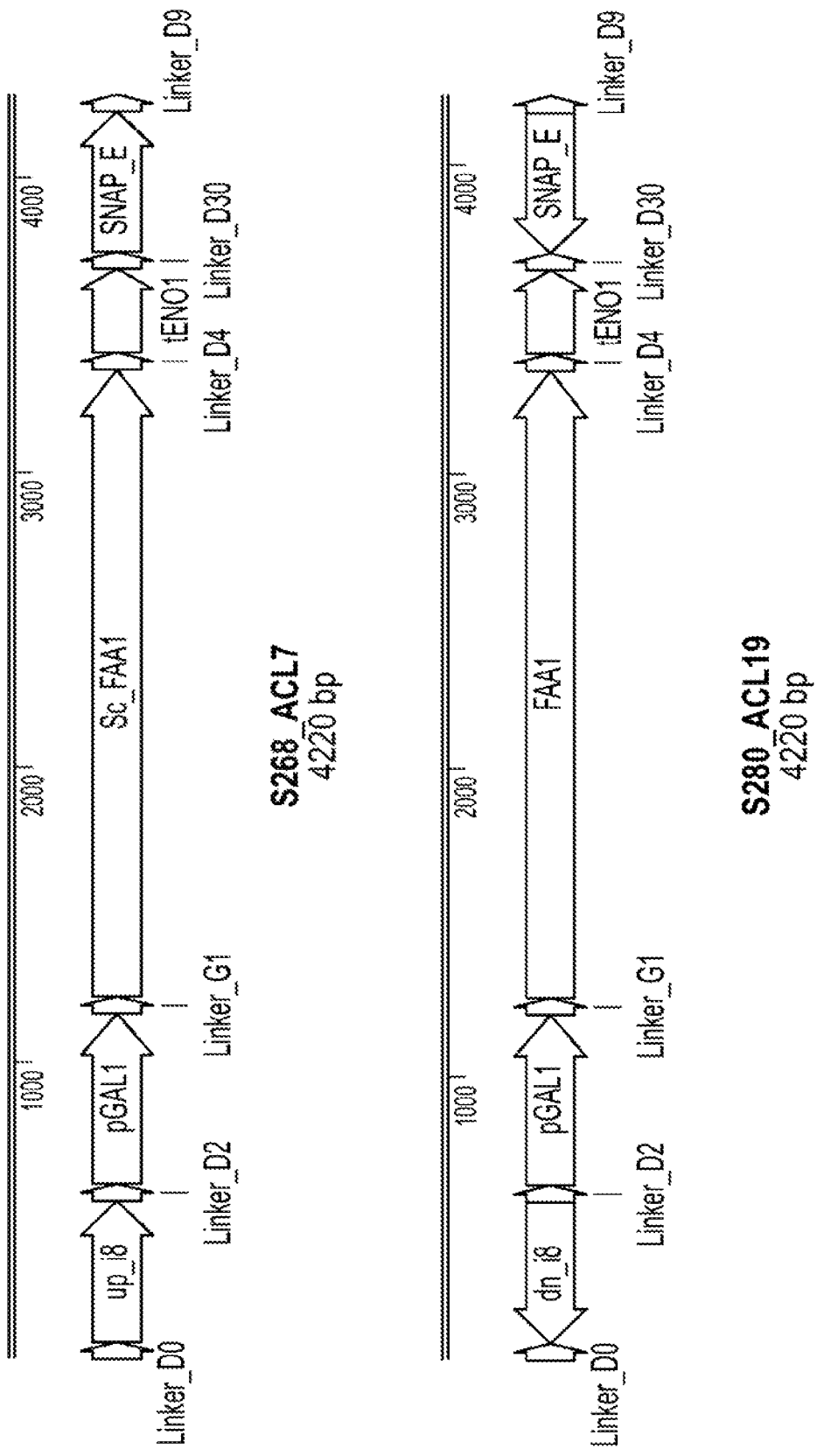
FIG. 48 depicts expression constructs used in the production of the S82 strain.
Figure 49:
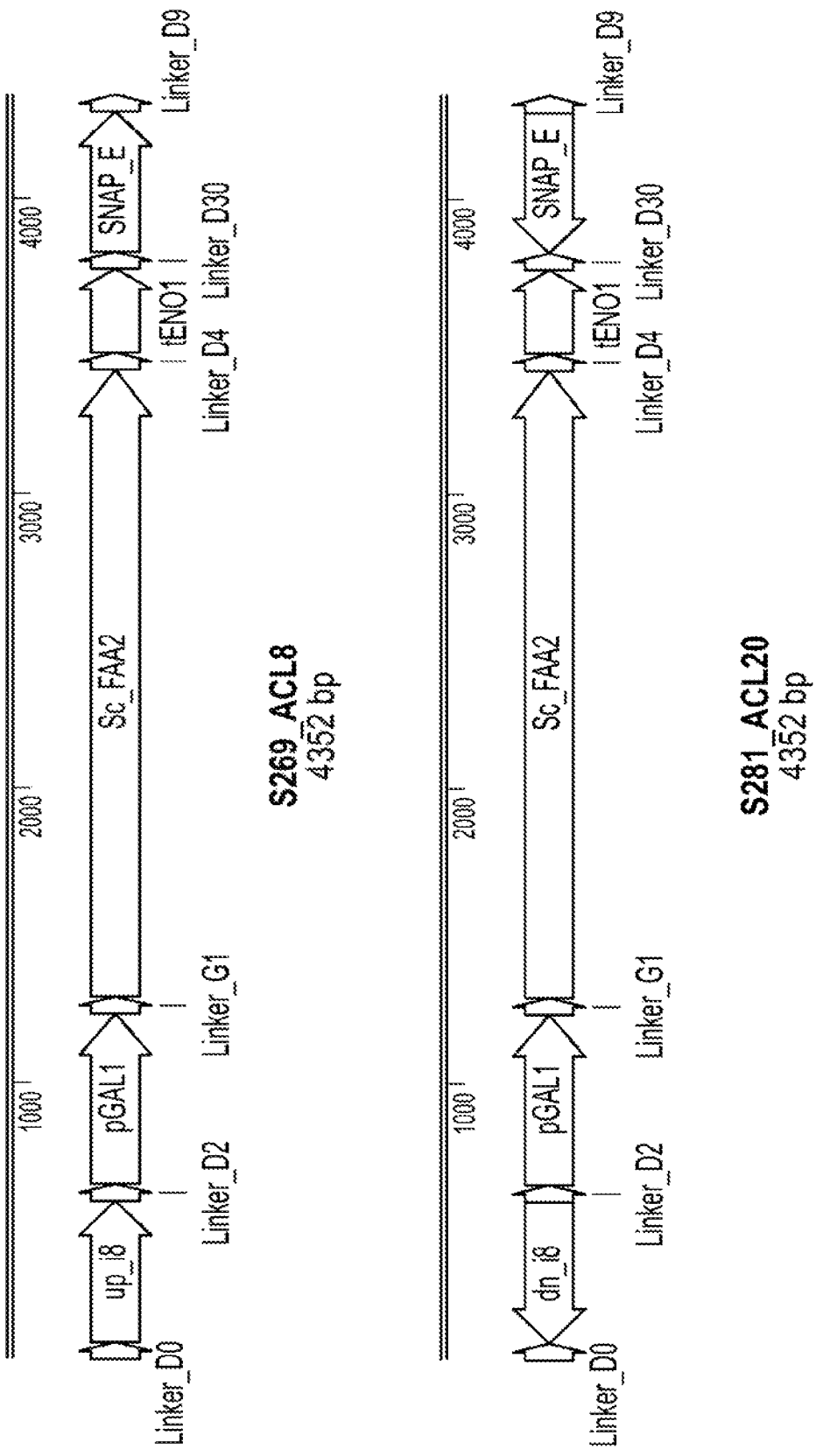
FIG. 49 depicts expression constructs used in the production of the S83 strain.
Figure 50:
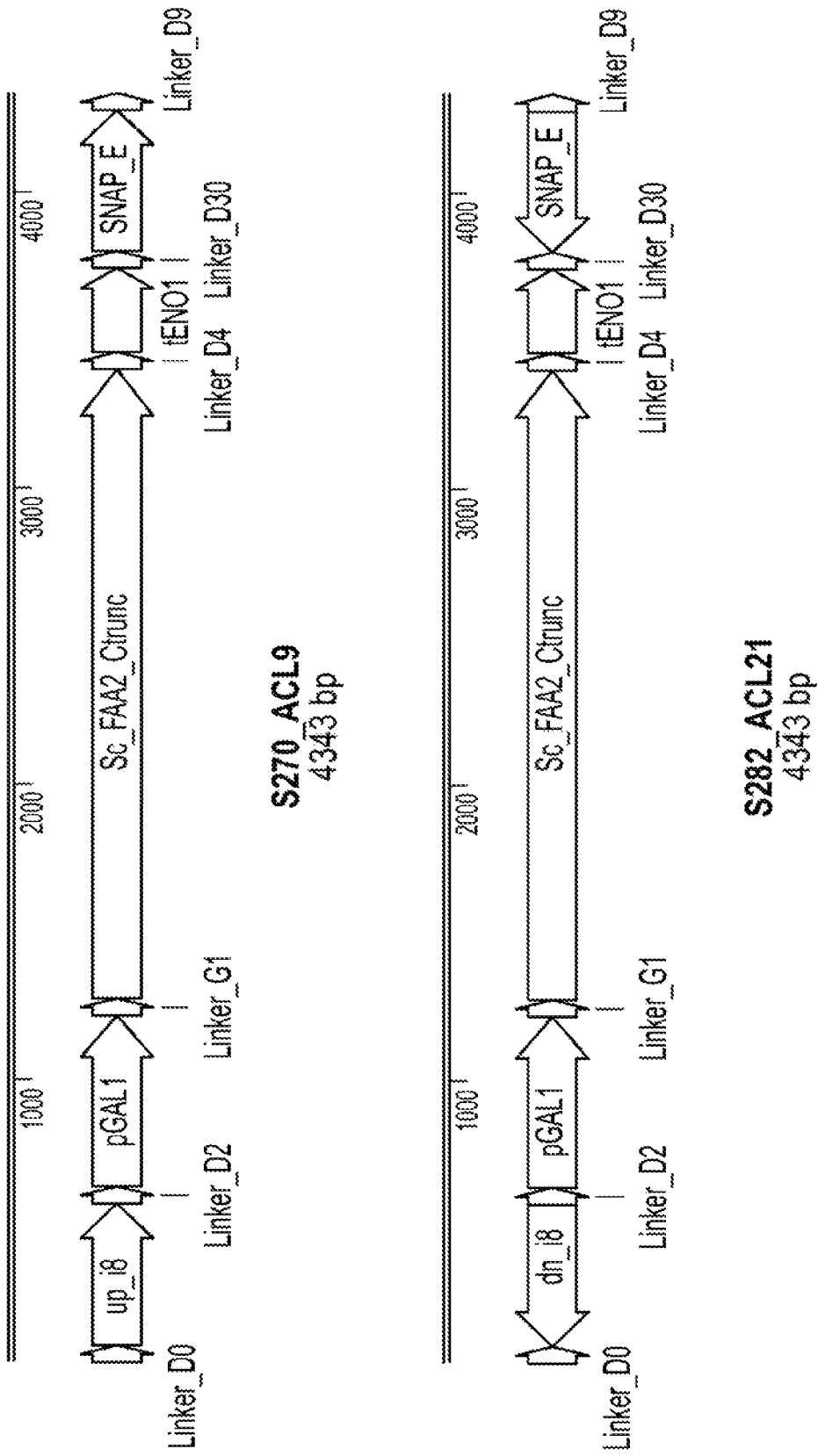
FIG. 50 depicts expression constructs used in the production of the S84 strain.
Figure 51:
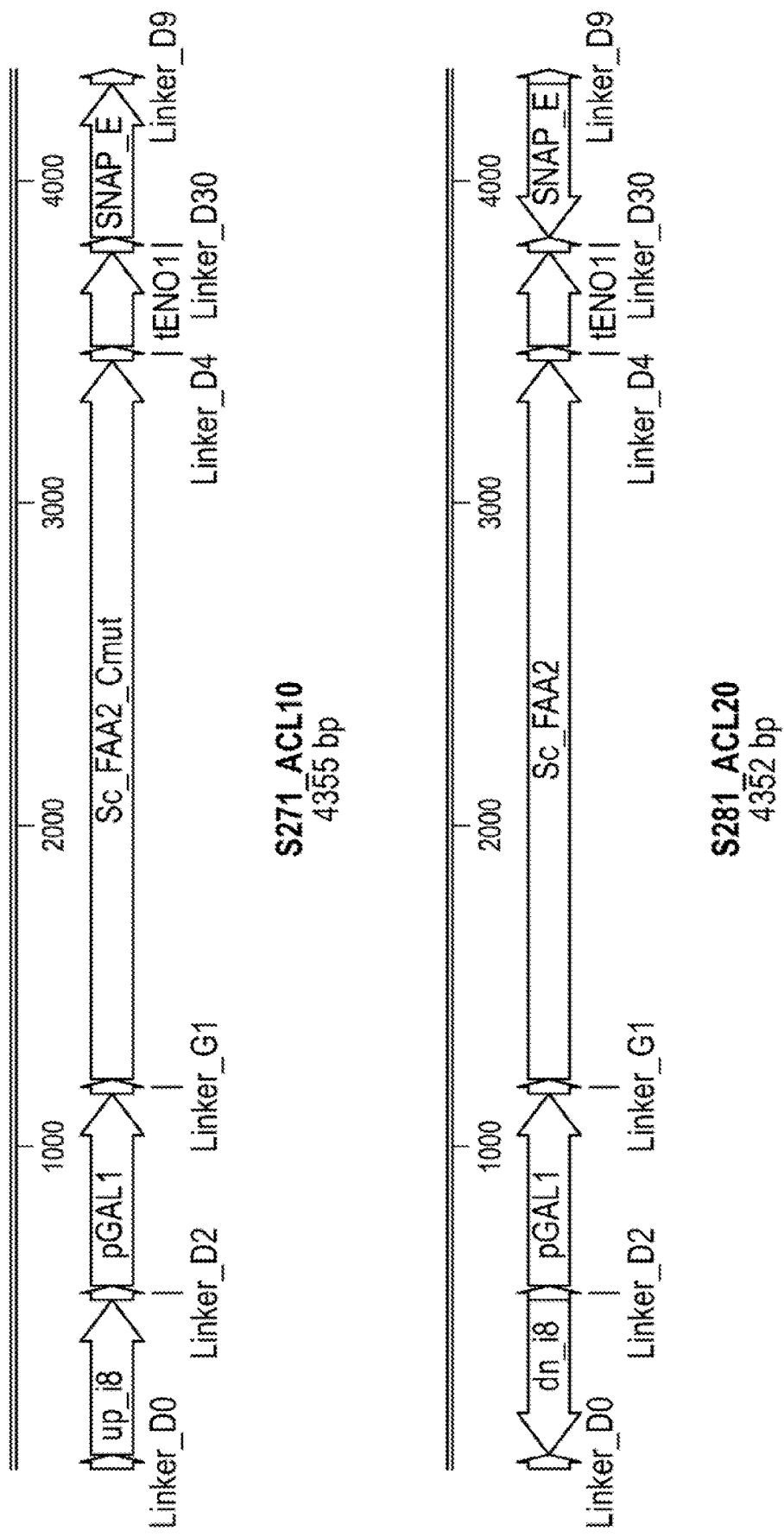
FIG. 51 depicts expression constructs used in the production of the S85 strain.
Figure 52:
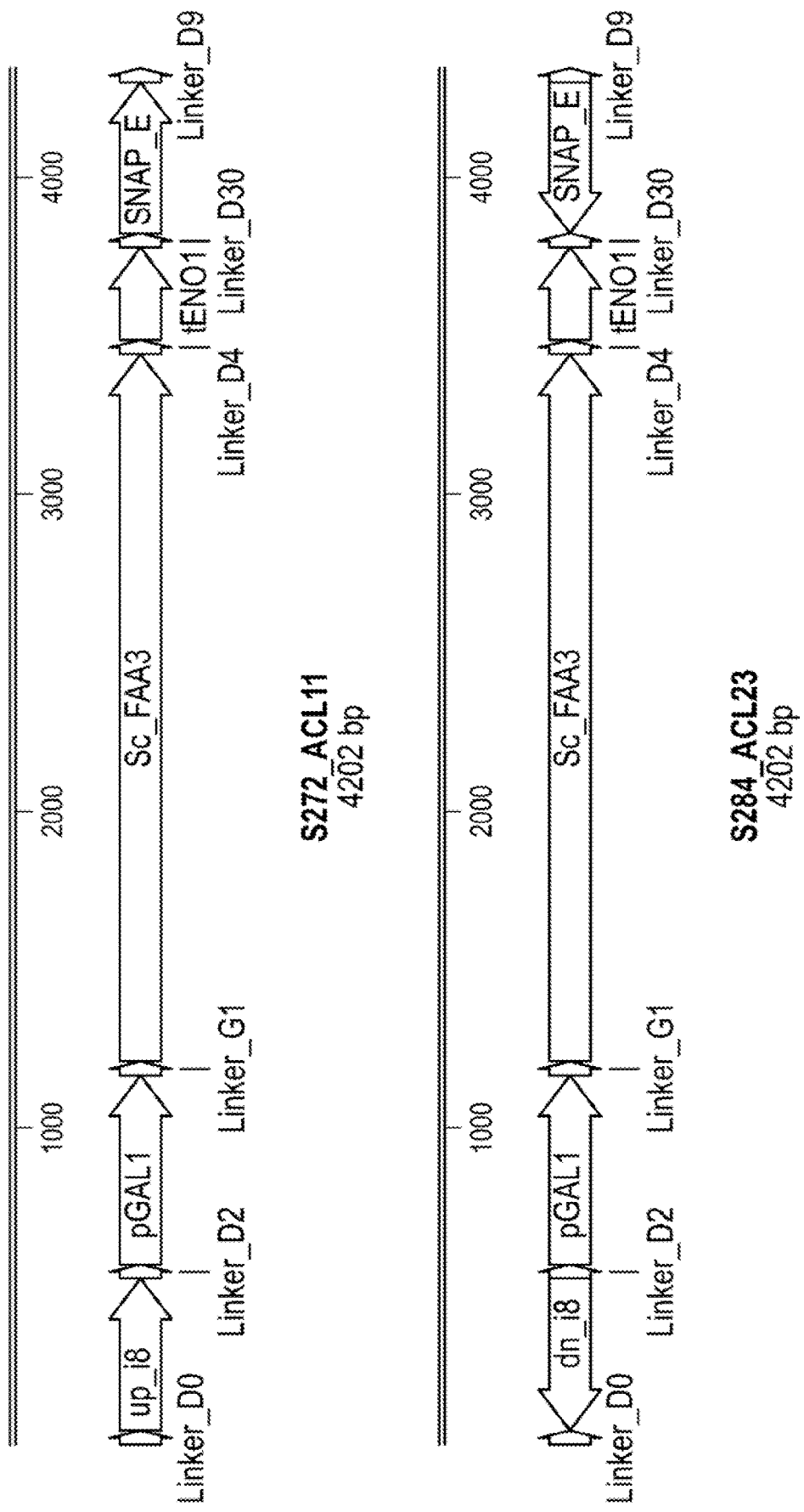
FIG. 52 depicts expression constructs used in the production of the S86 strain.
Figure 53:
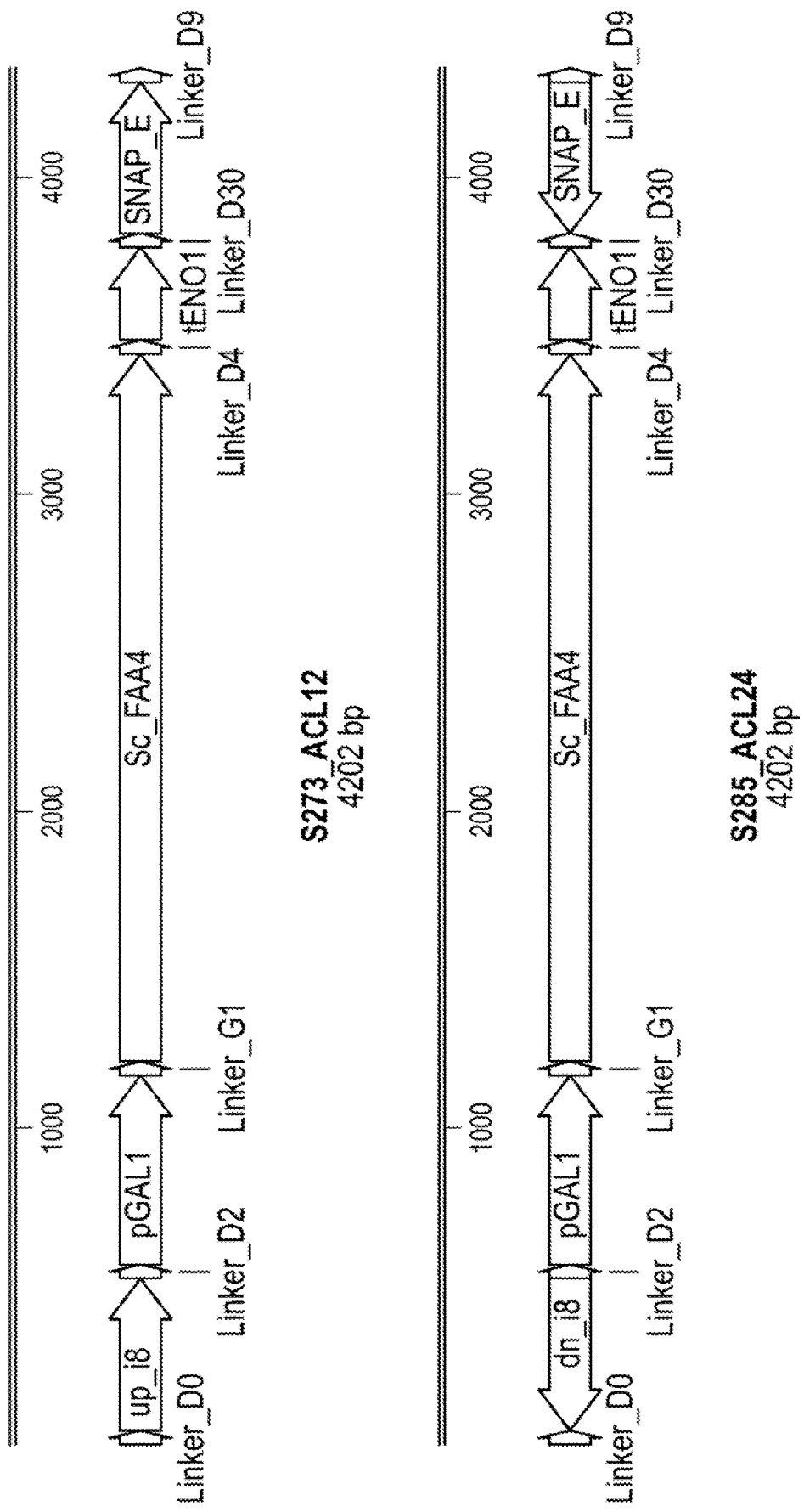
FIG. 53 depicts expression constructs used in the production of the S87 strain.
Figure 54:
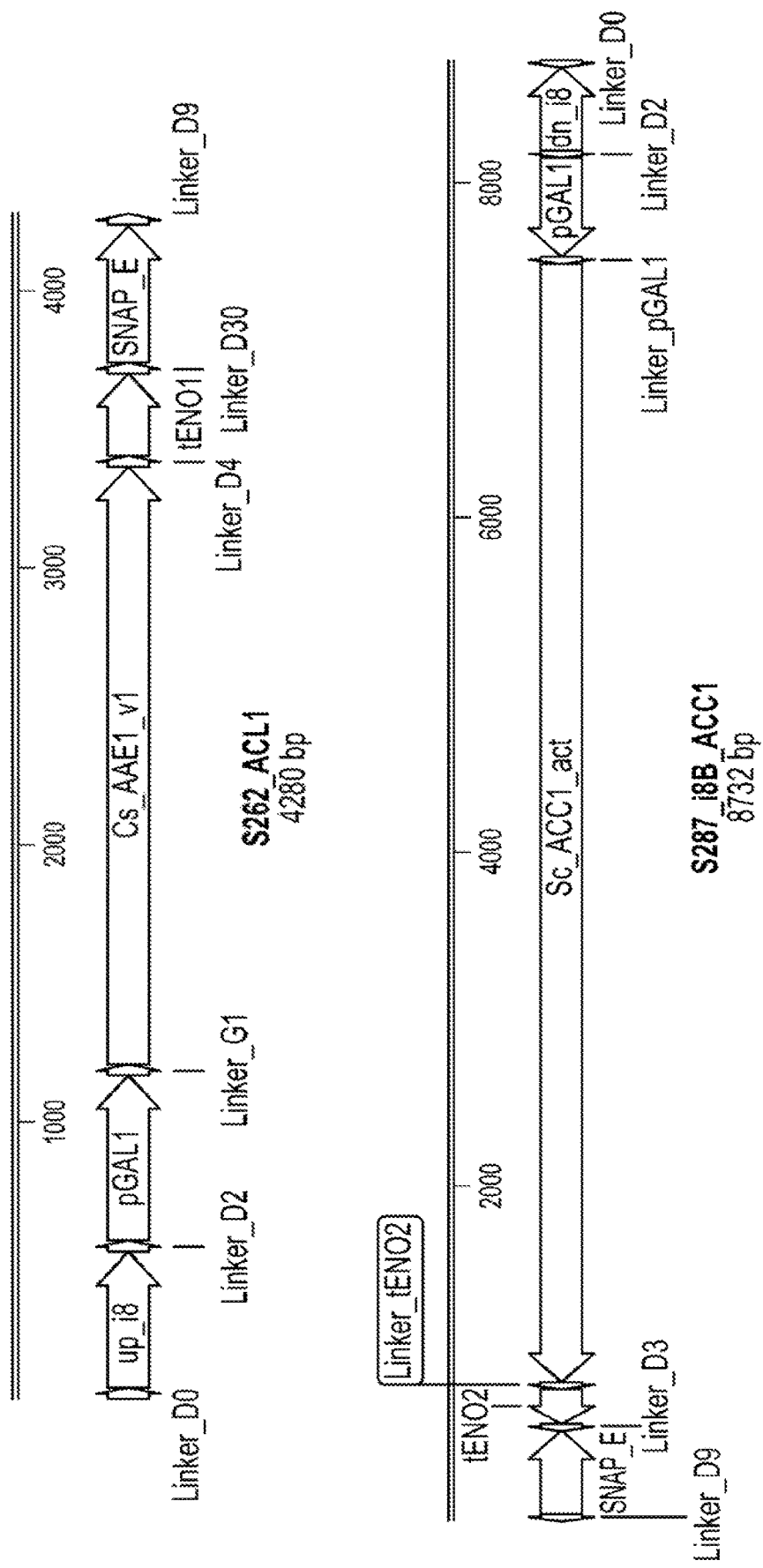
FIG. 54 depicts expression constructs used in the production of the S88 strain.
Figure 55:
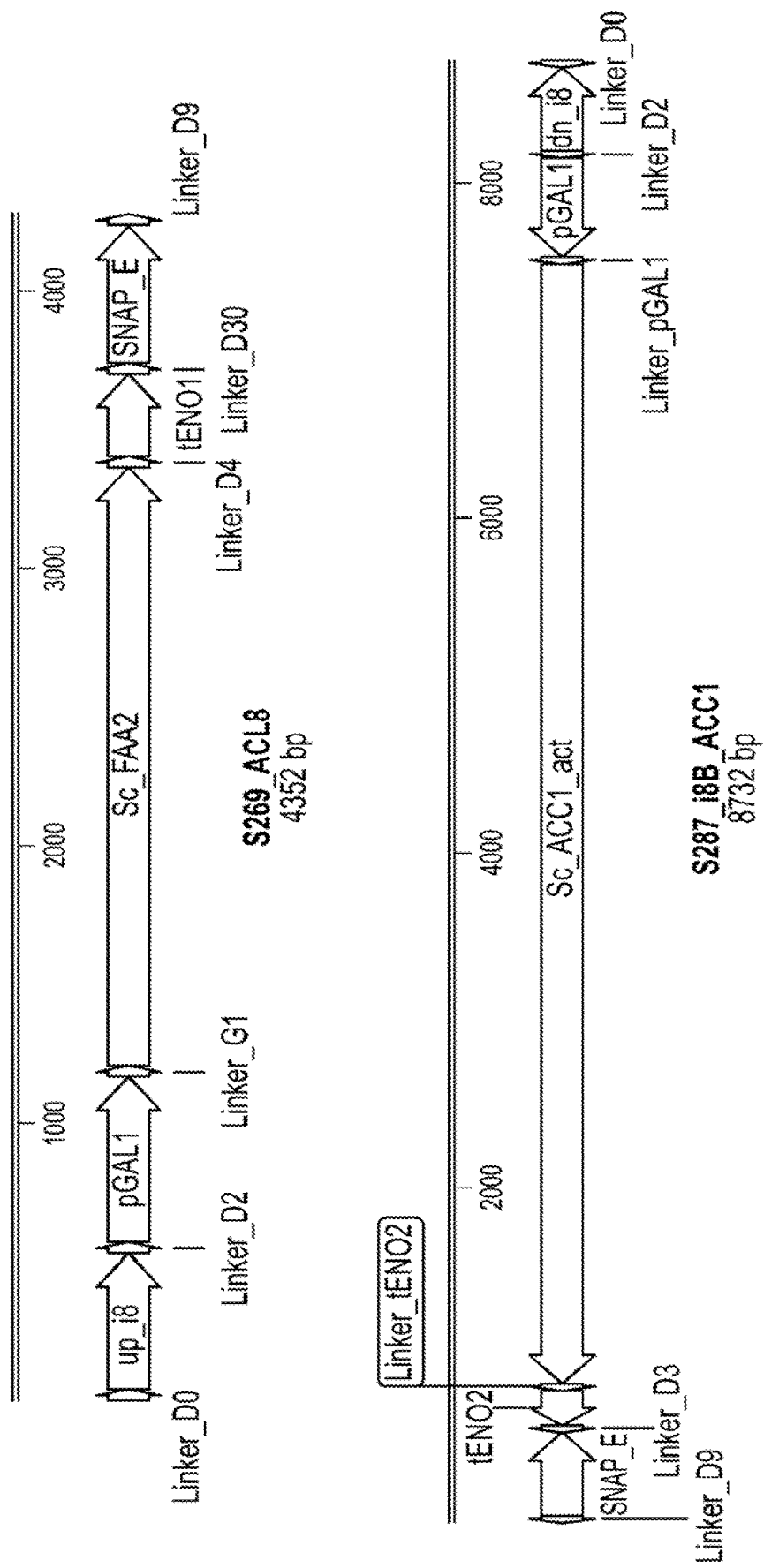
FIG. 55 depicts expression constructs used in the production of the S89 strain.
Figure 56A:
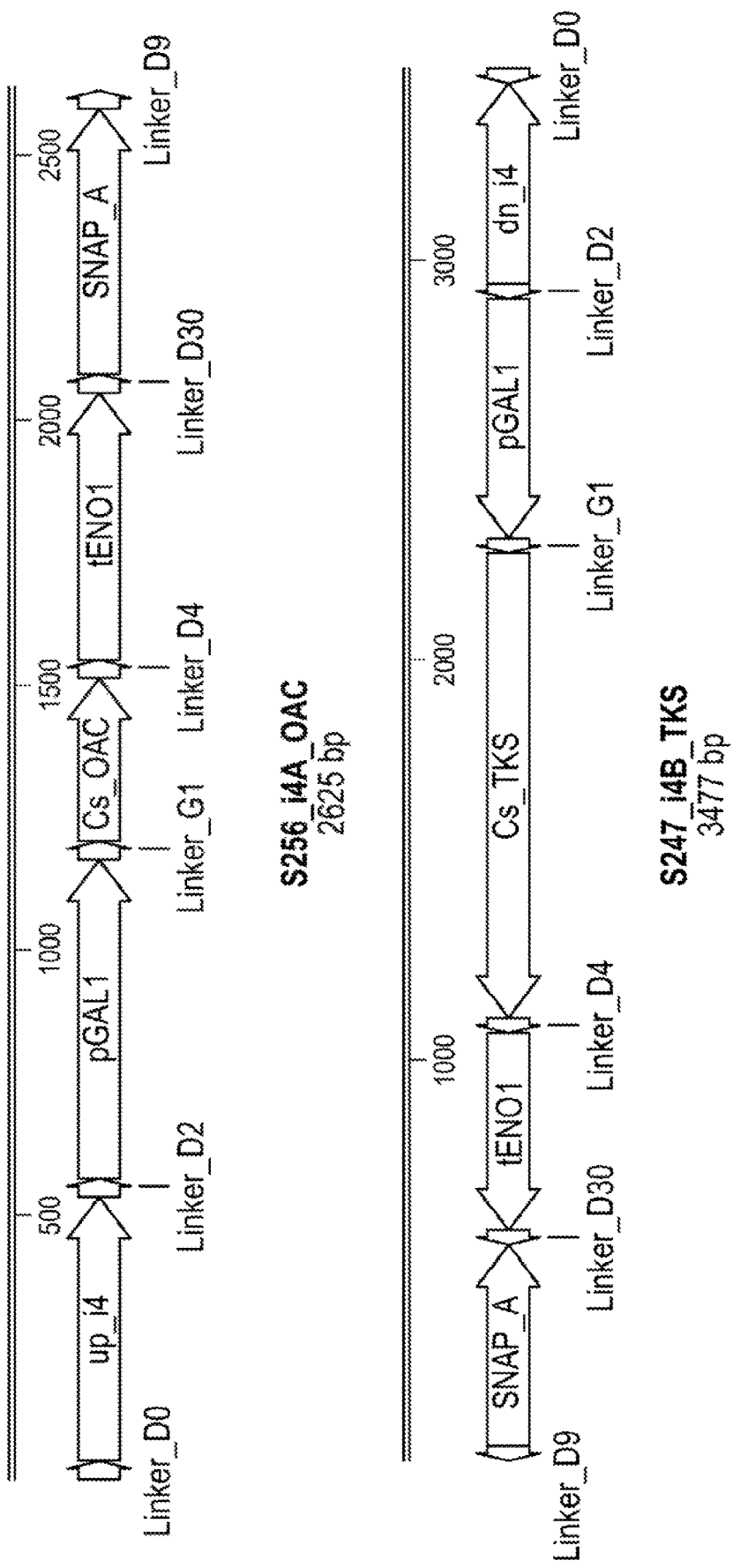
FIGS. 56A, 56B, and 56C depict expression constructs used in the production of the S90 strain.
Figure 56B:
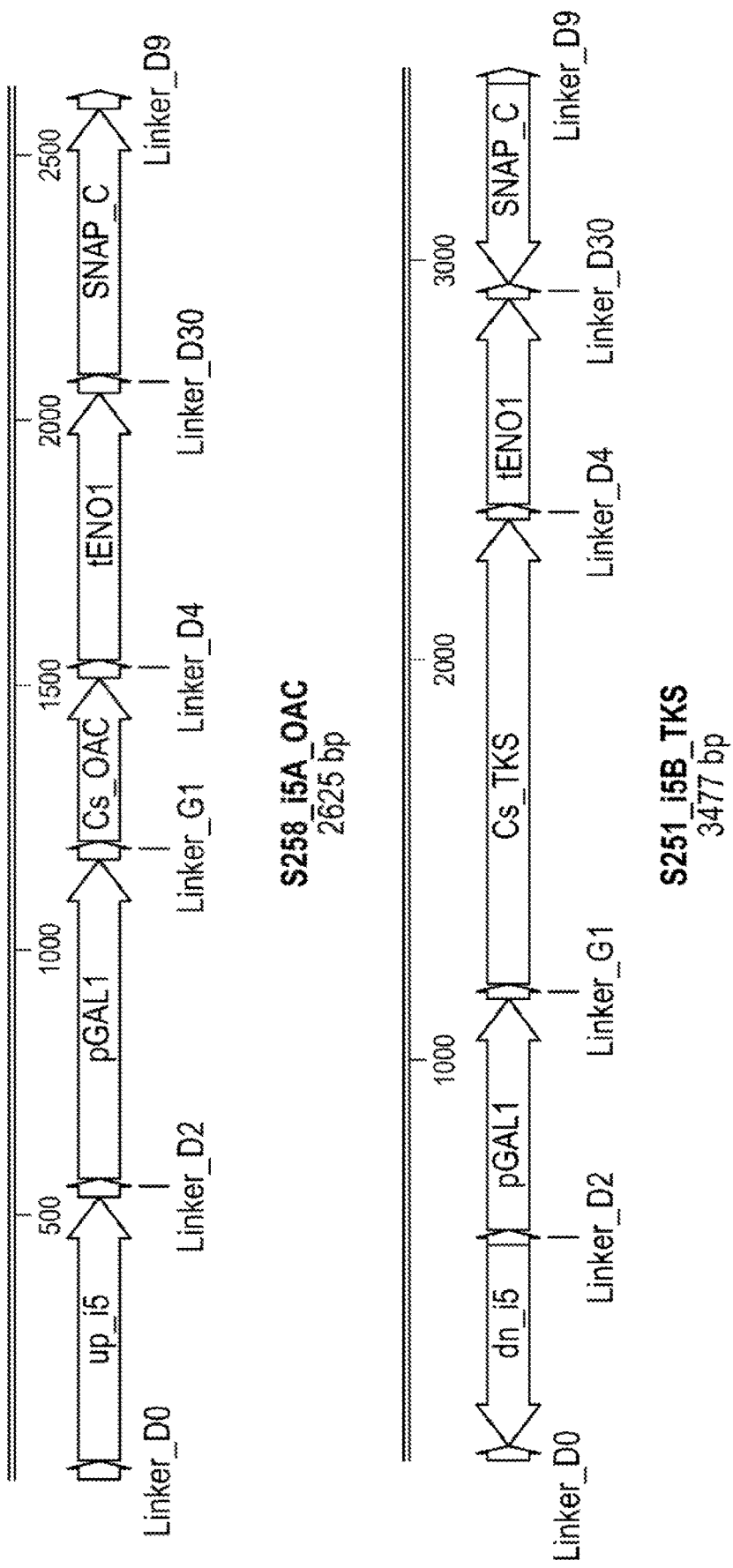
Figure 56C:
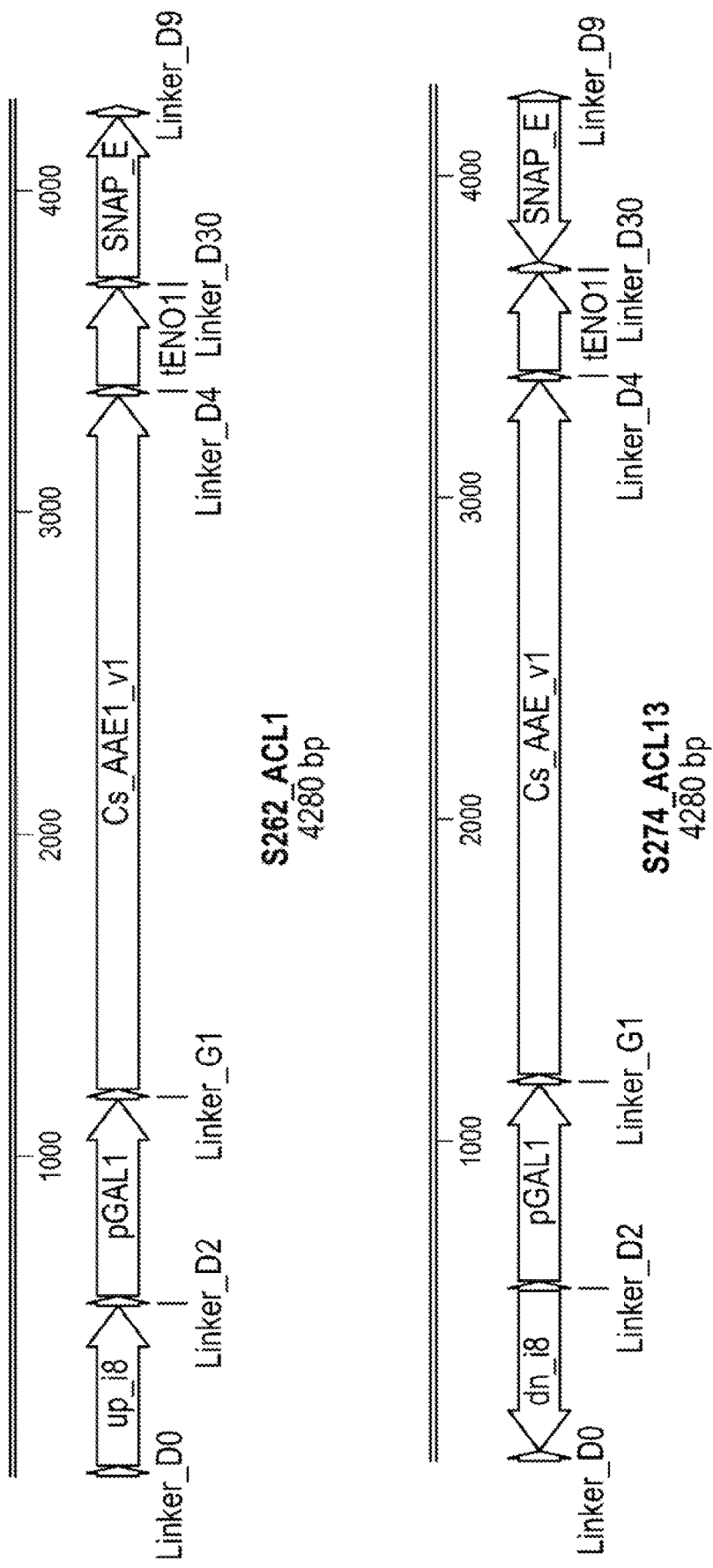
Figure 57A:
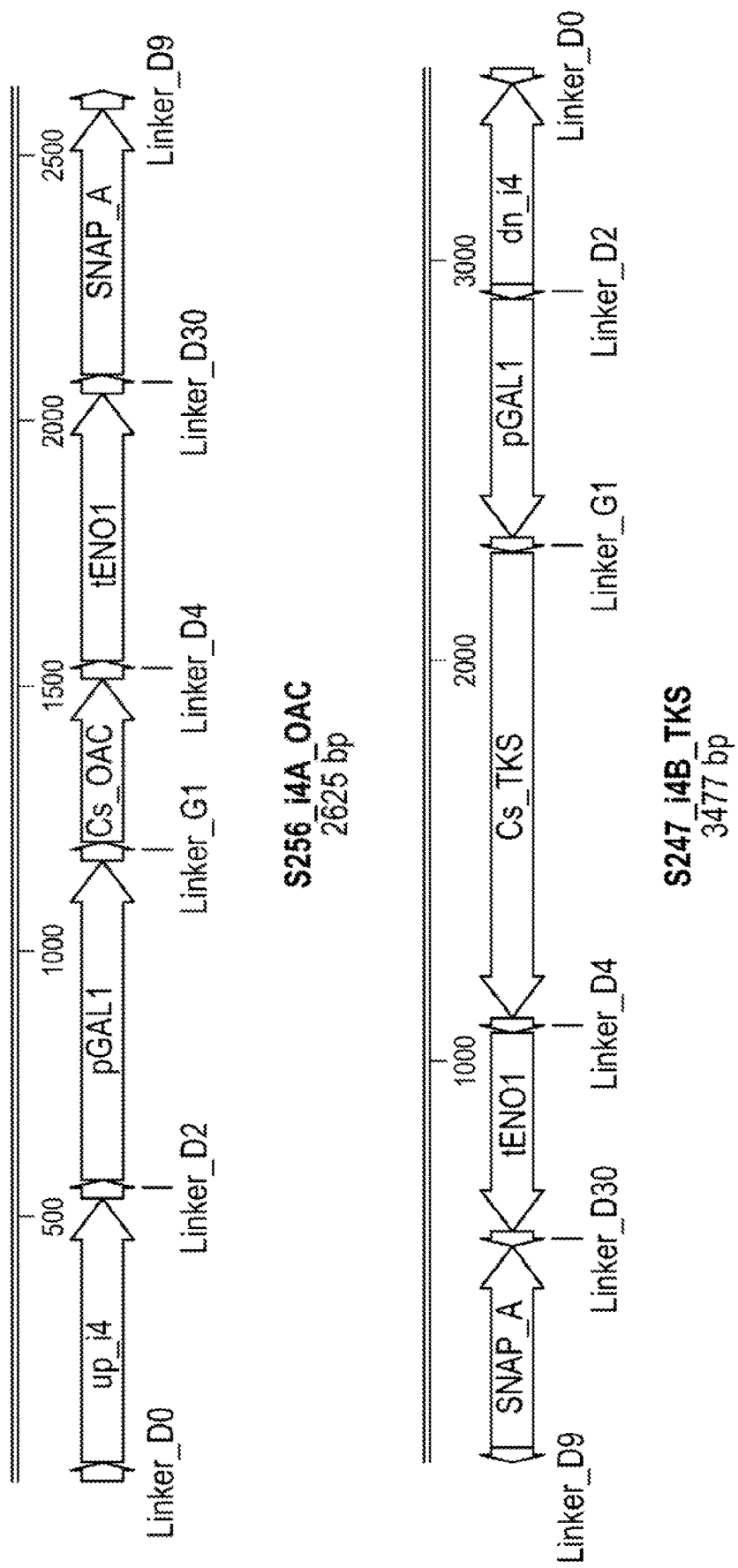
FIGS. 57A, 57B, and 57C depict expression constructs used in the production of the S91 strain.
Figure 57B:
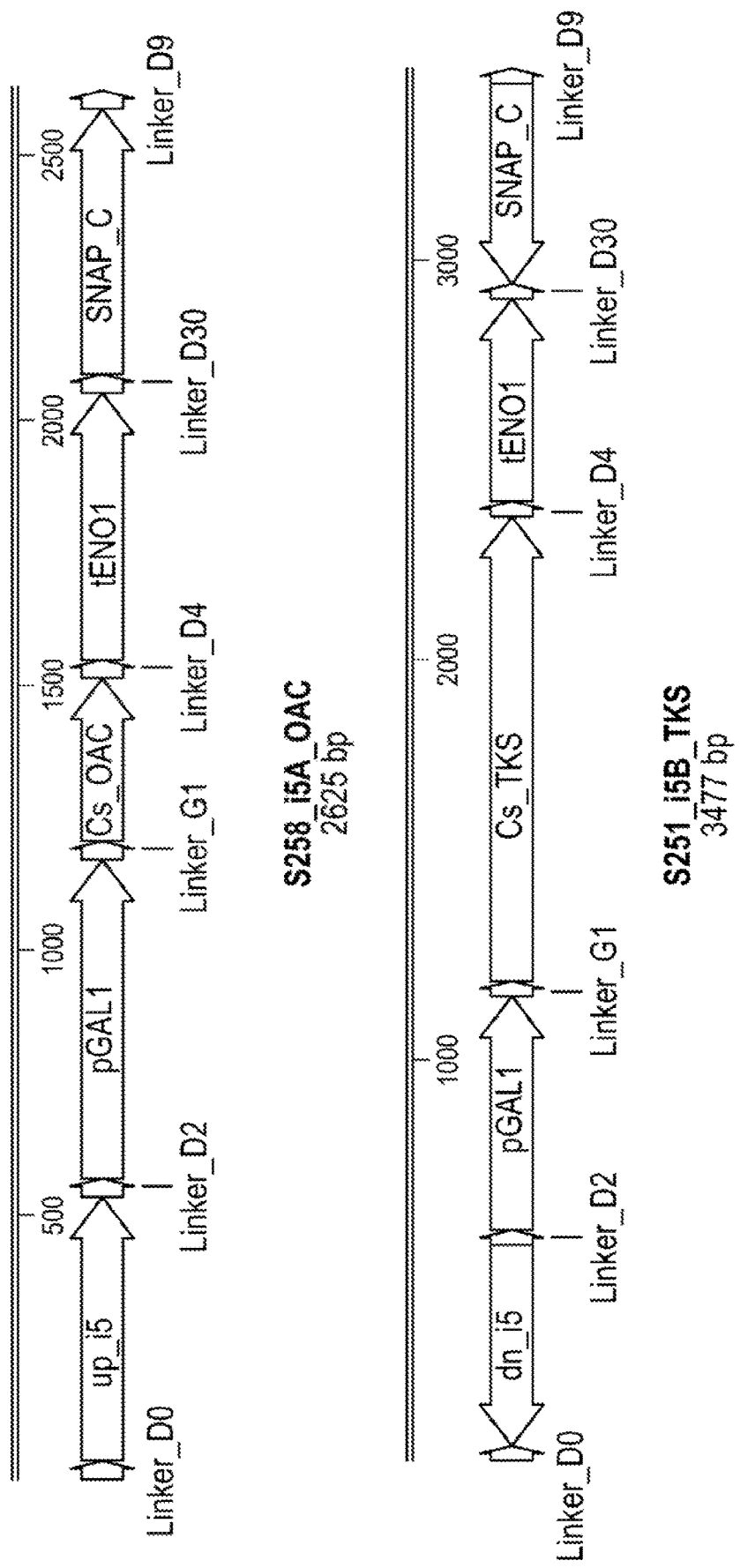
Figure 57C:
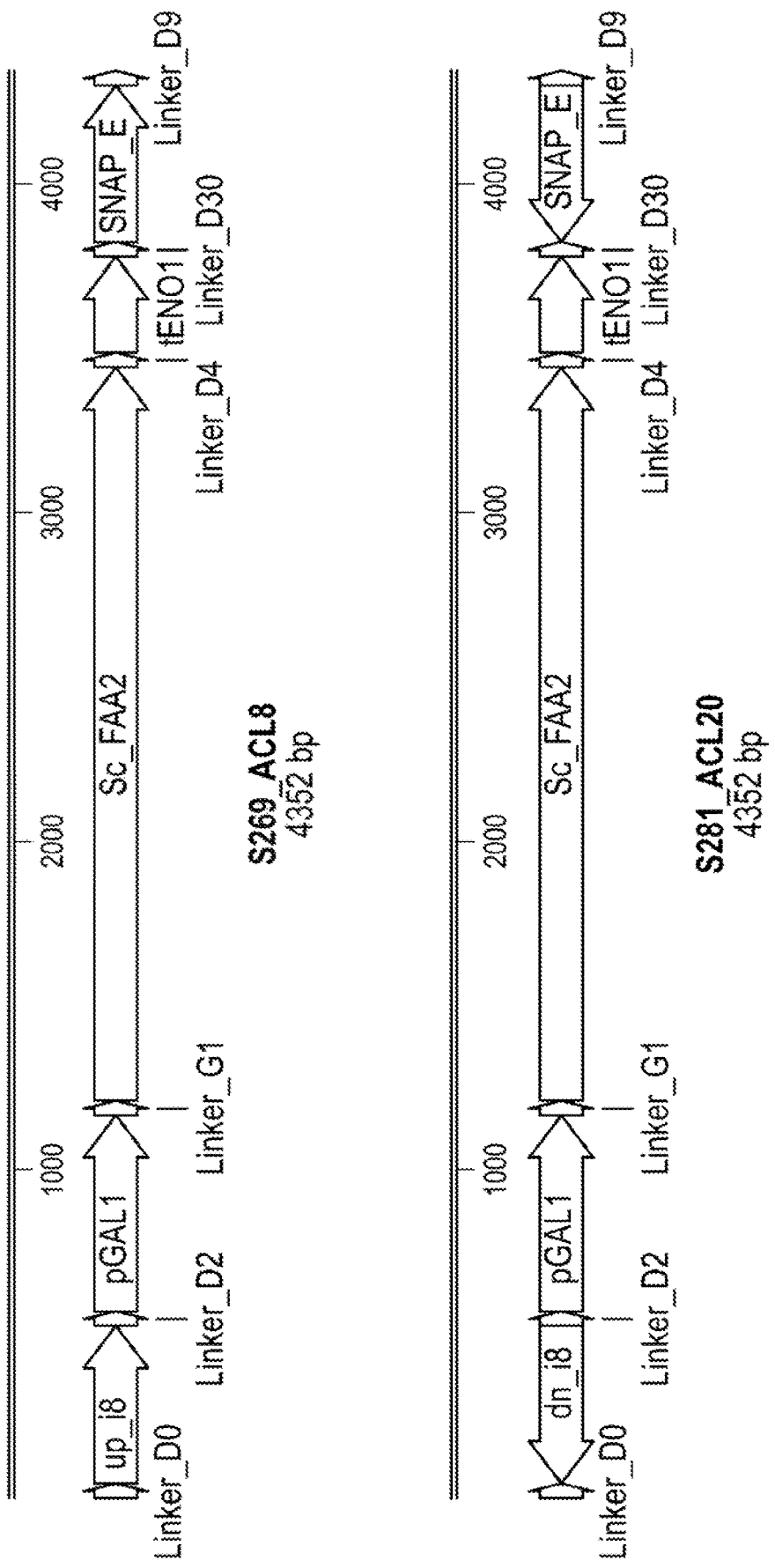
Figure 58:
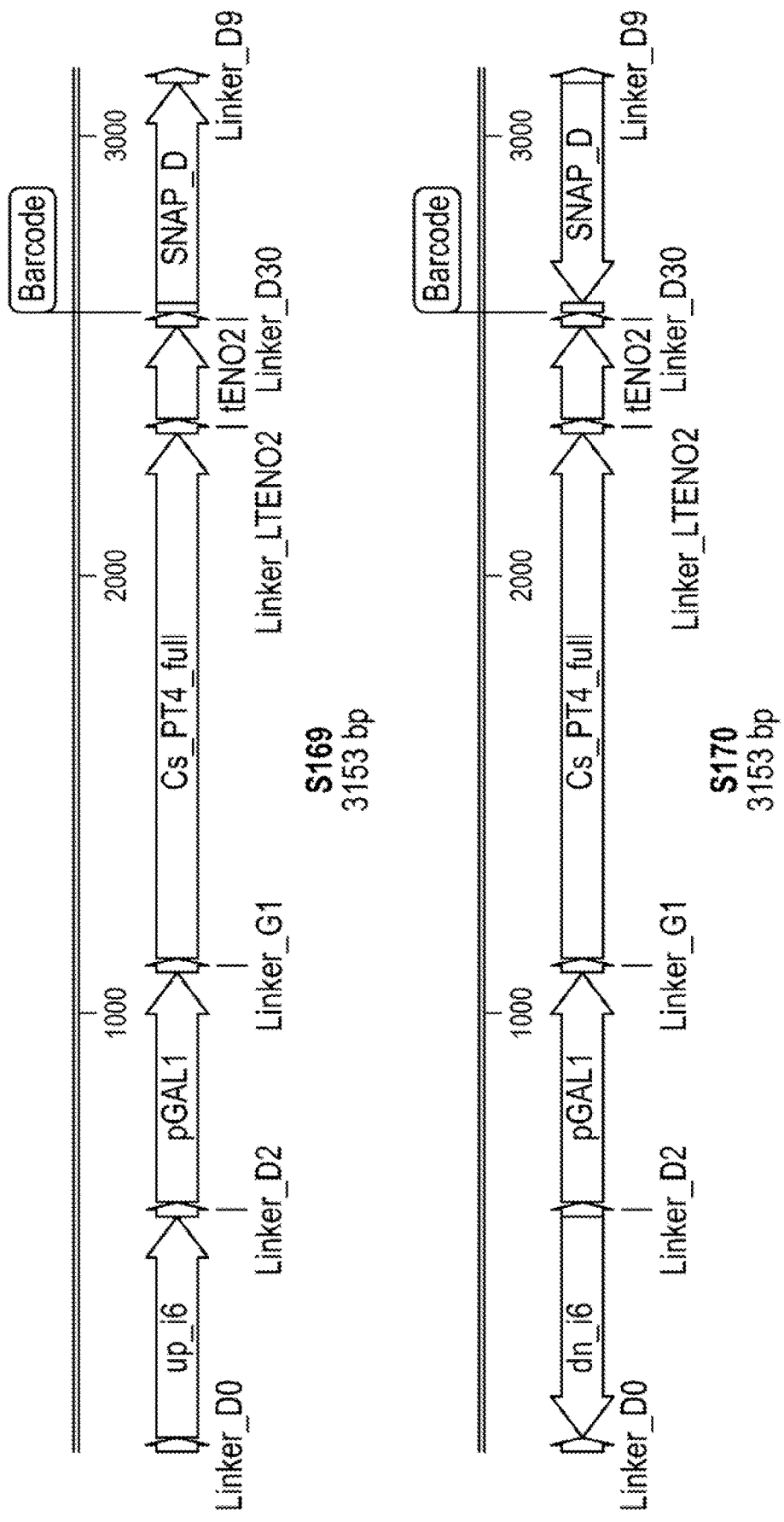
FIG. 58 depicts expression constructs used in the production of the S94 strain.
Figure 59:
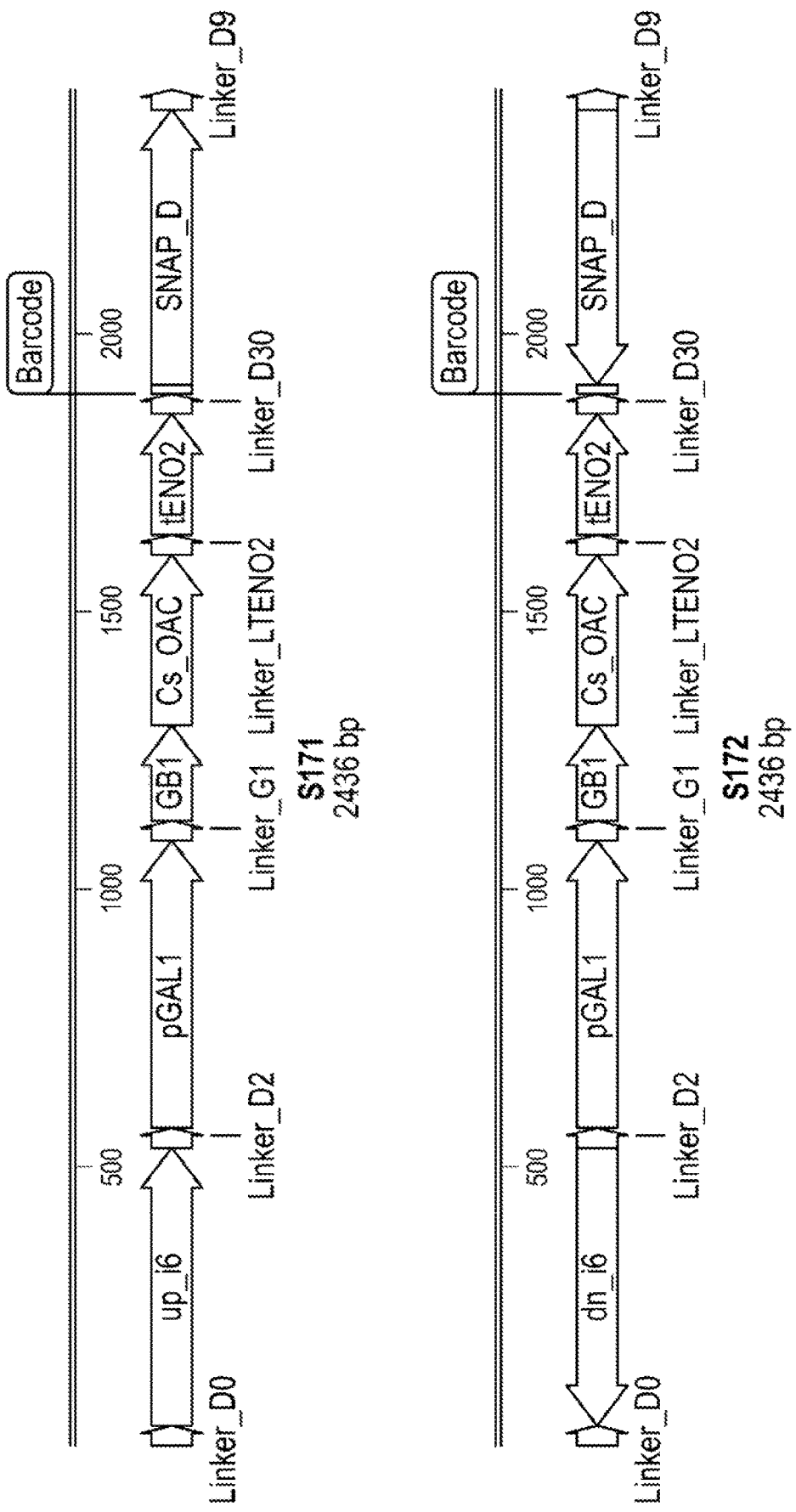
FIG. 59 depicts expression constructs used in the production of the S95 strain.
Figure 60:
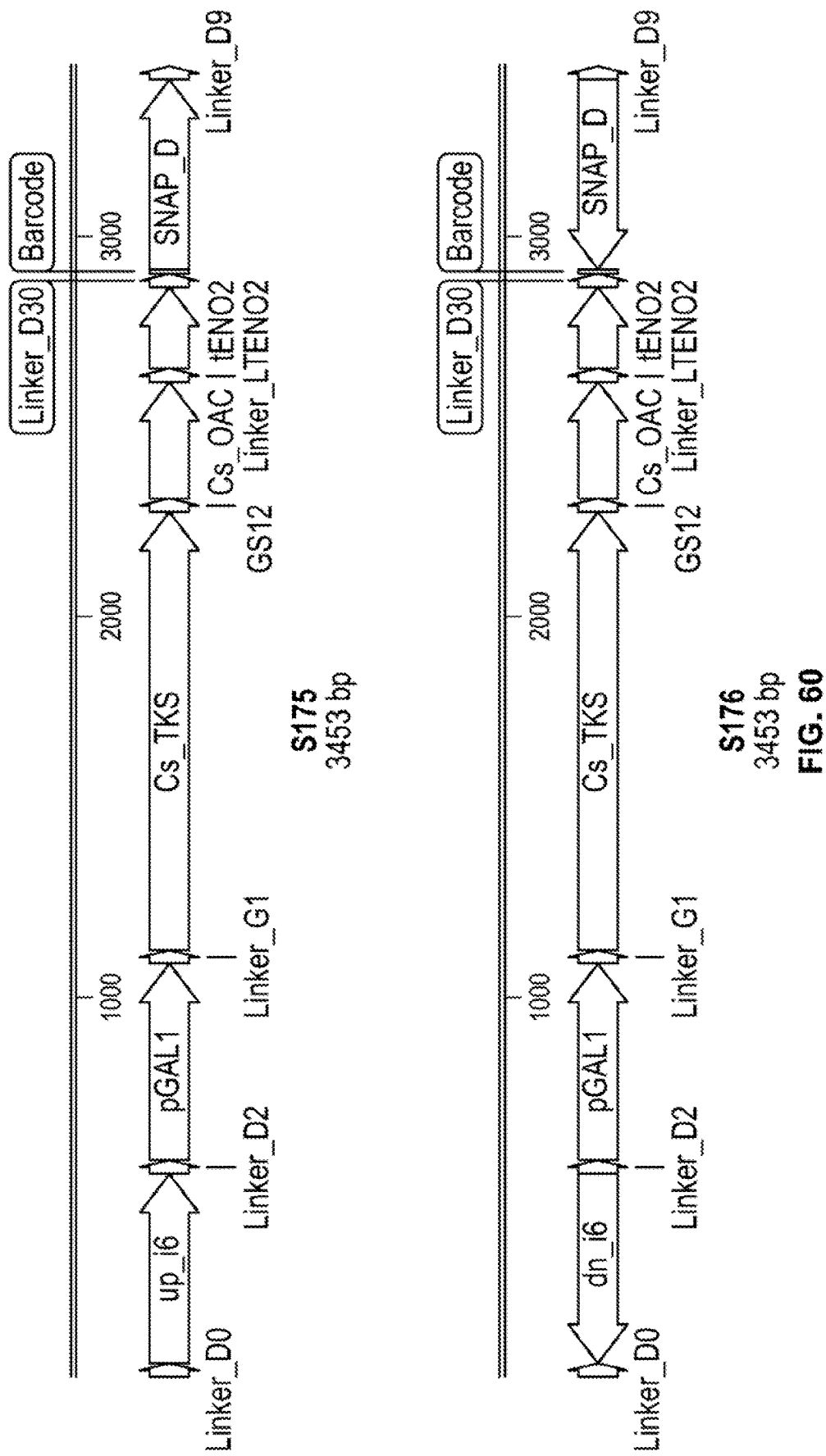
FIG. 60 depicts expression constructs used in the production of the S97 strain.
Figure 61:
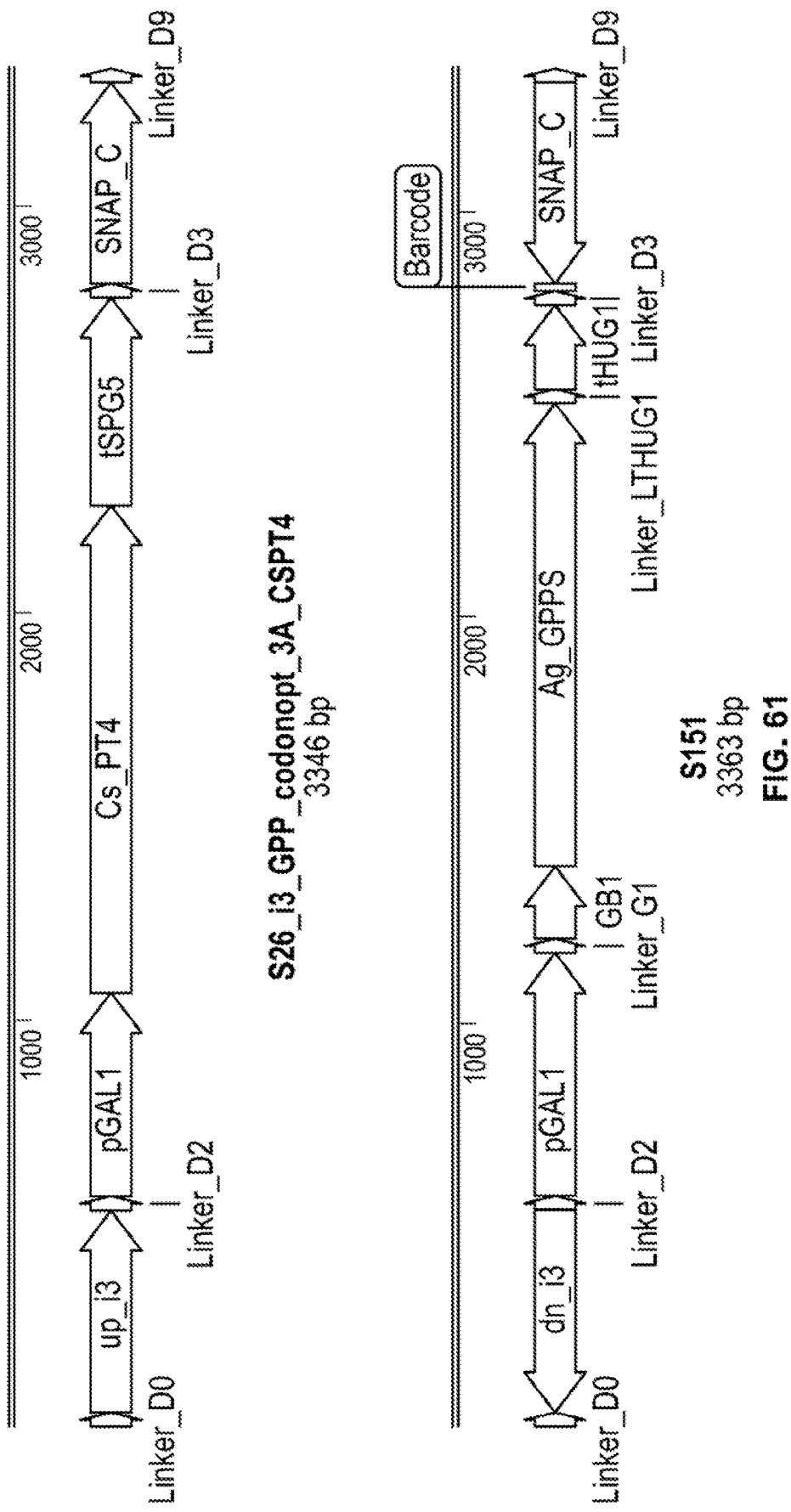
FIG. 61 depicts expression constructs used in the production of the S104 strain.
Figure 62:
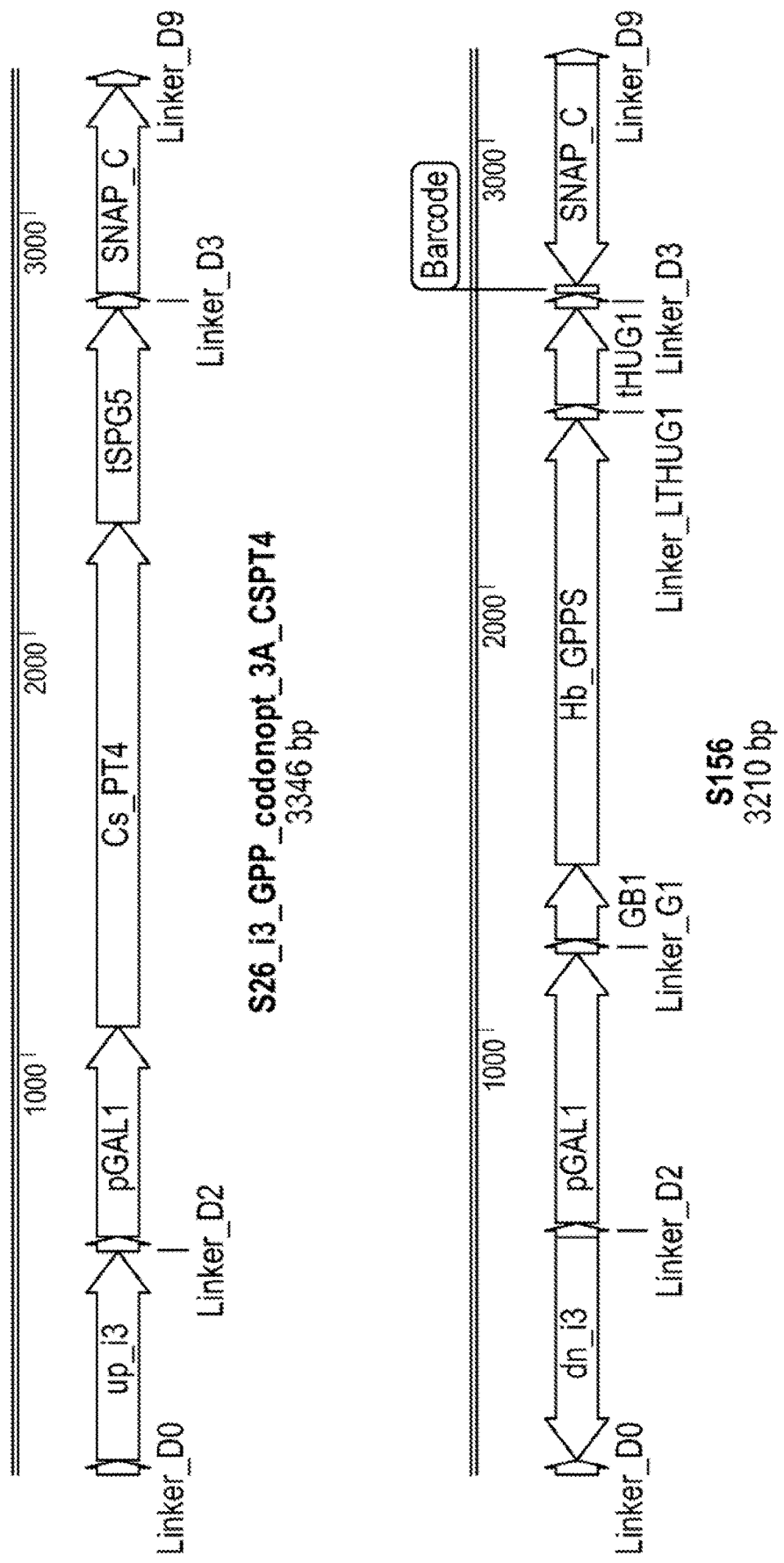
FIG. 62 depicts expression constructs used in the production of the S108 strain.
Figure 63:
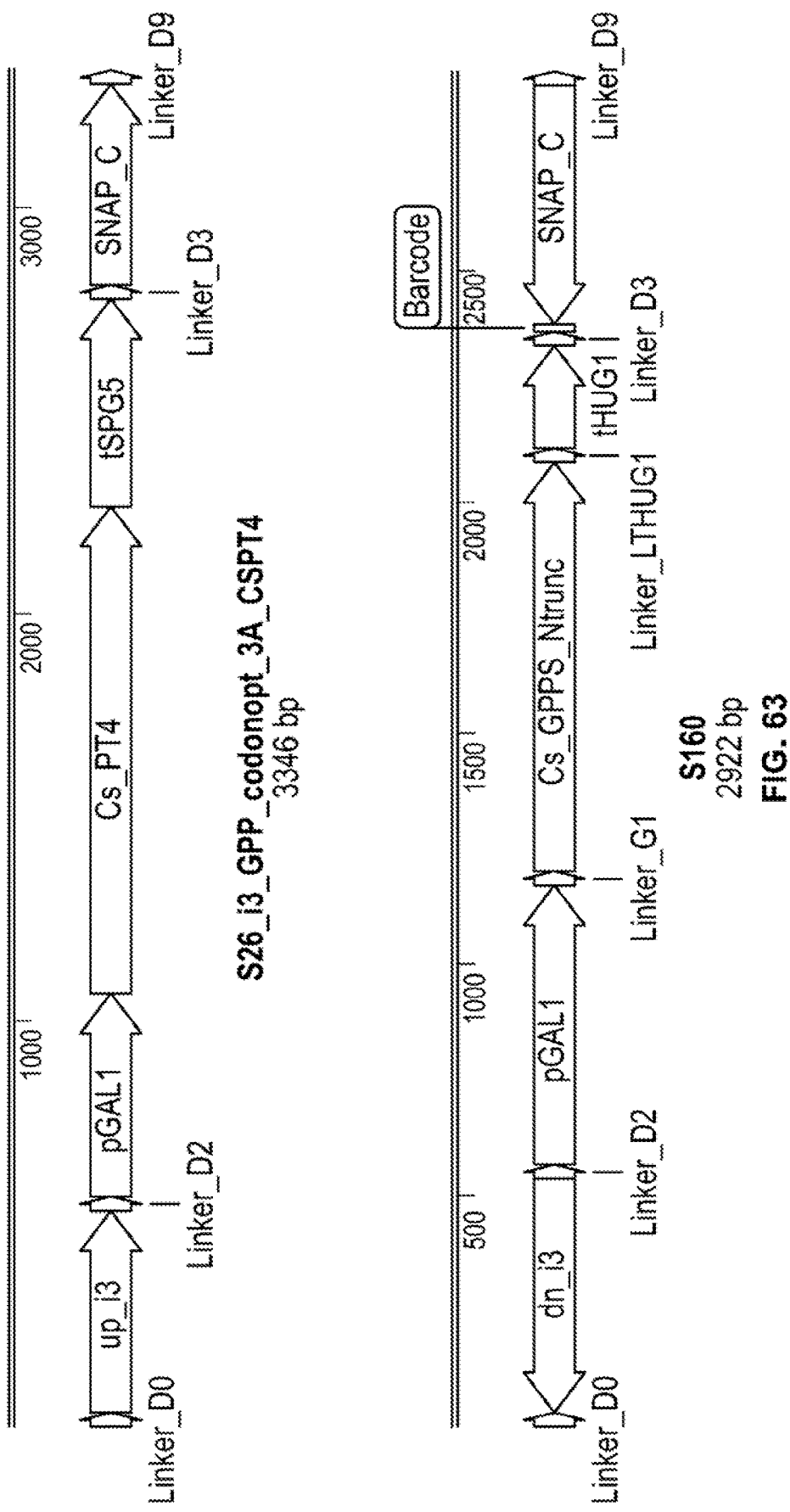
FIG. 63 depicts expression constructs used in the production of the S112 strain.
Figure 64:
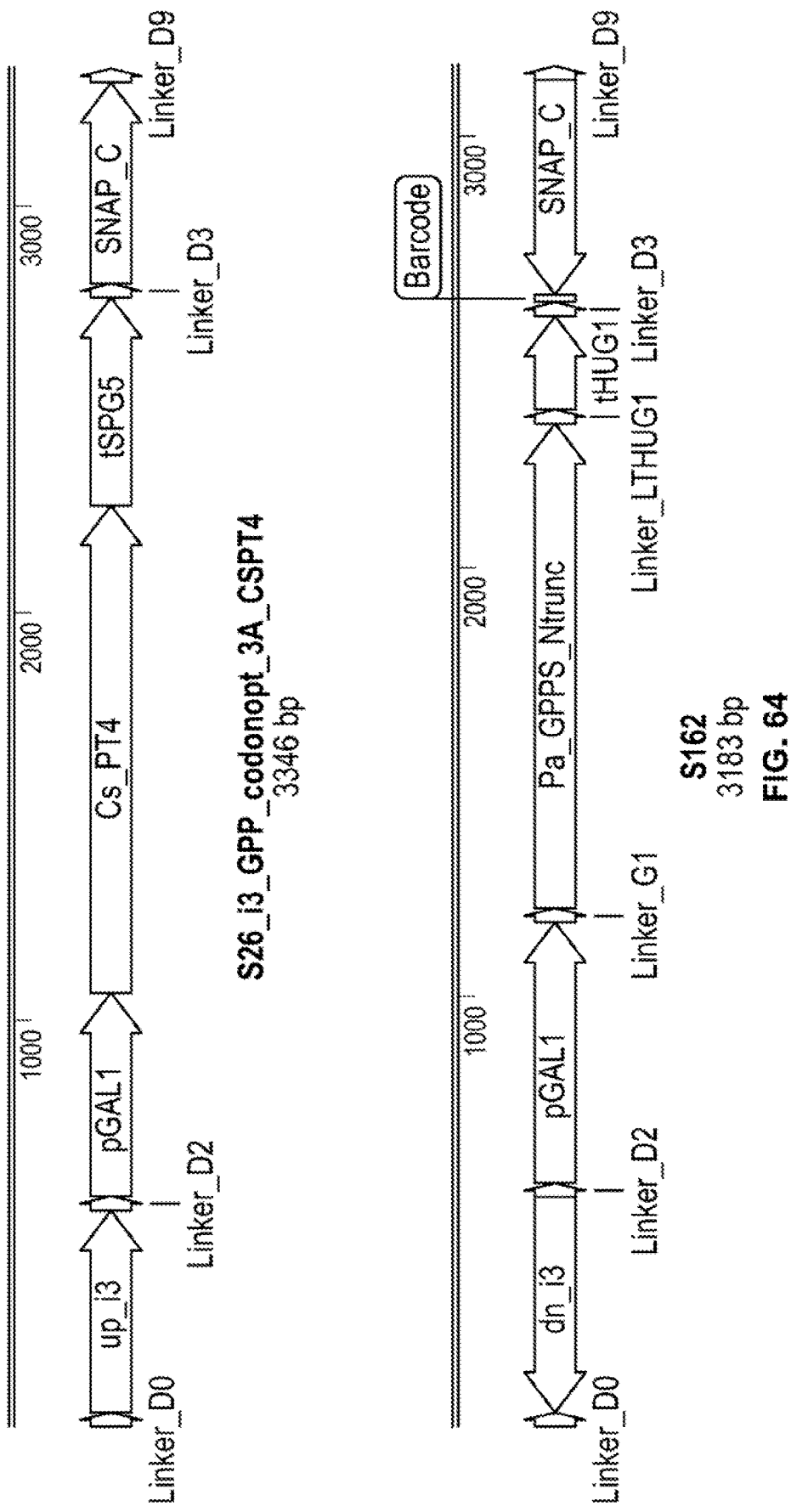
FIG. 64 depicts expression constructs used in the production of the S114 strain.
Figure 65:
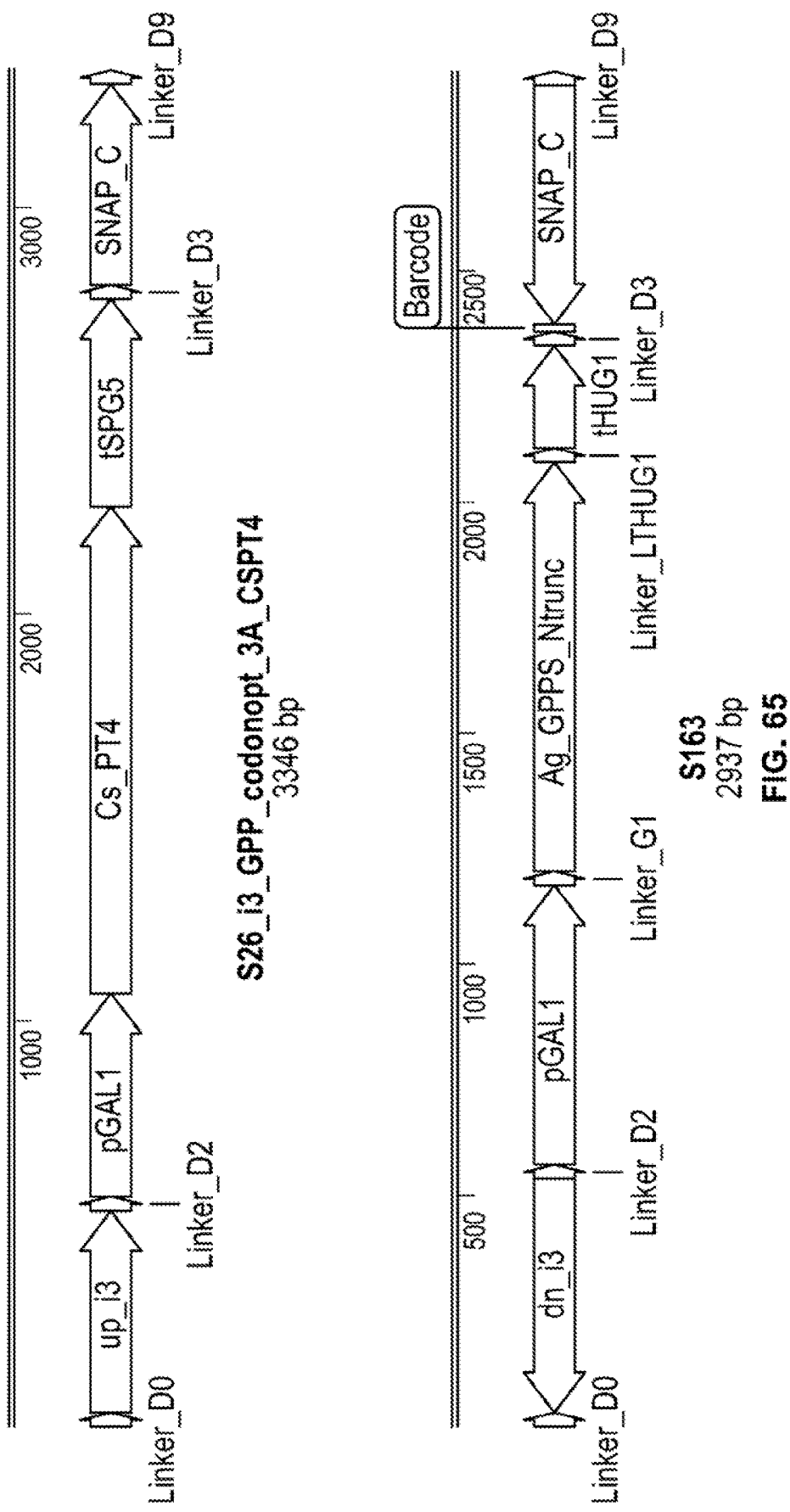
FIG. 65 depicts expression constructs used in the production of the S115 strain.
Figure 66:
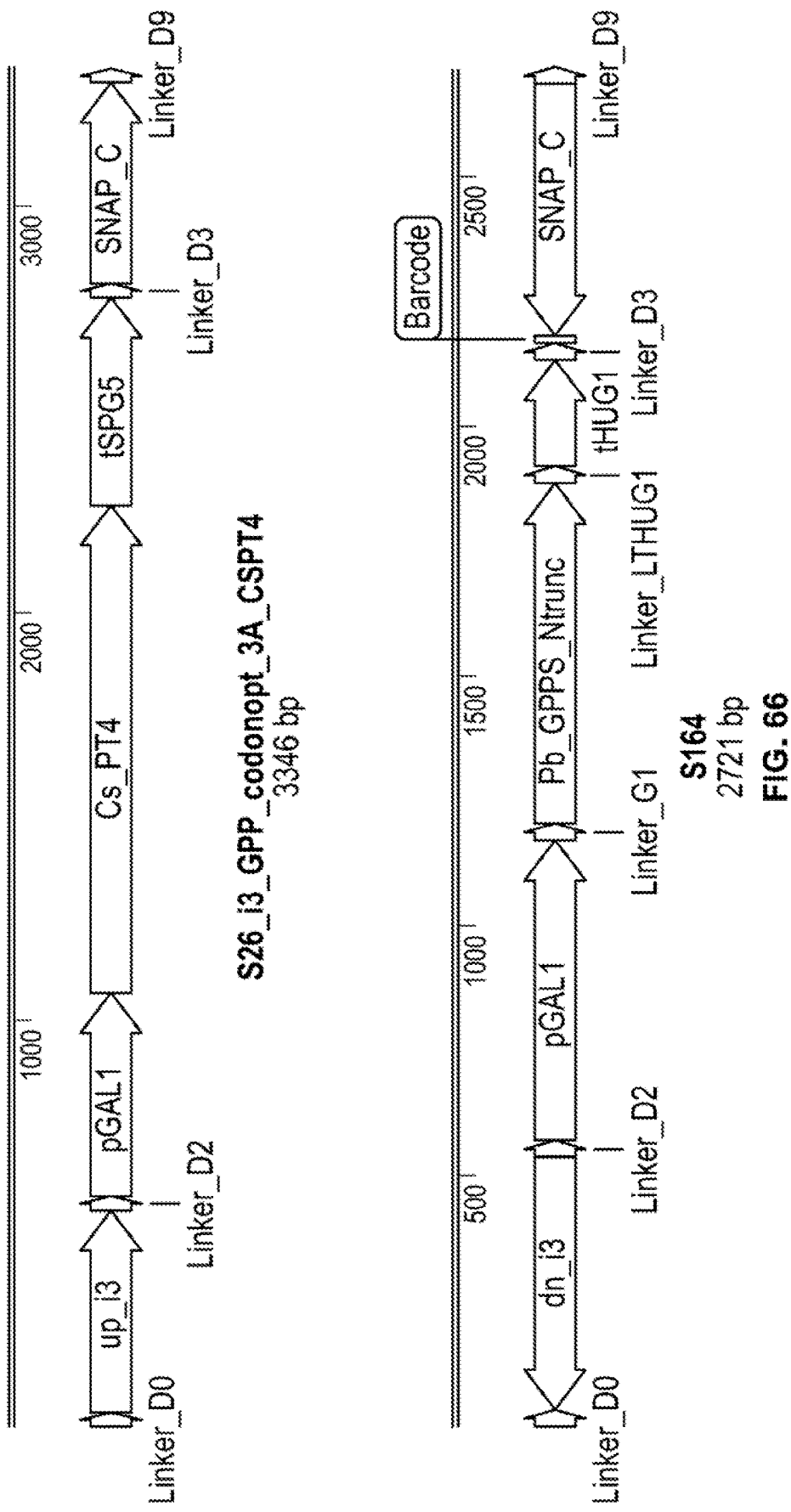
FIG. 66 depicts expression constructs used in the production of the S116 strain.
Figure 67:
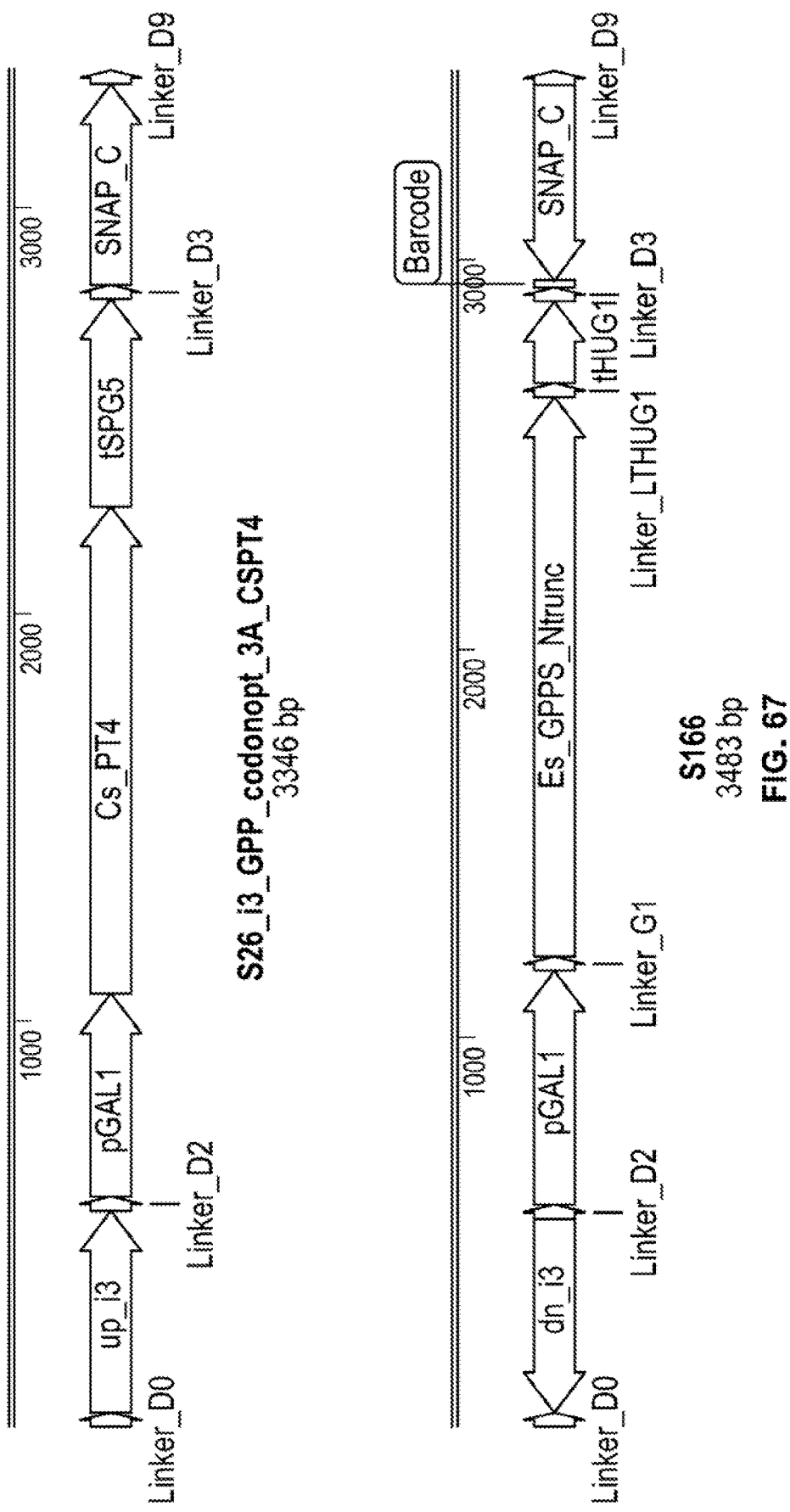
FIG. 67 depicts expression constructs used in the production of the S118 strain.
Figure 68:
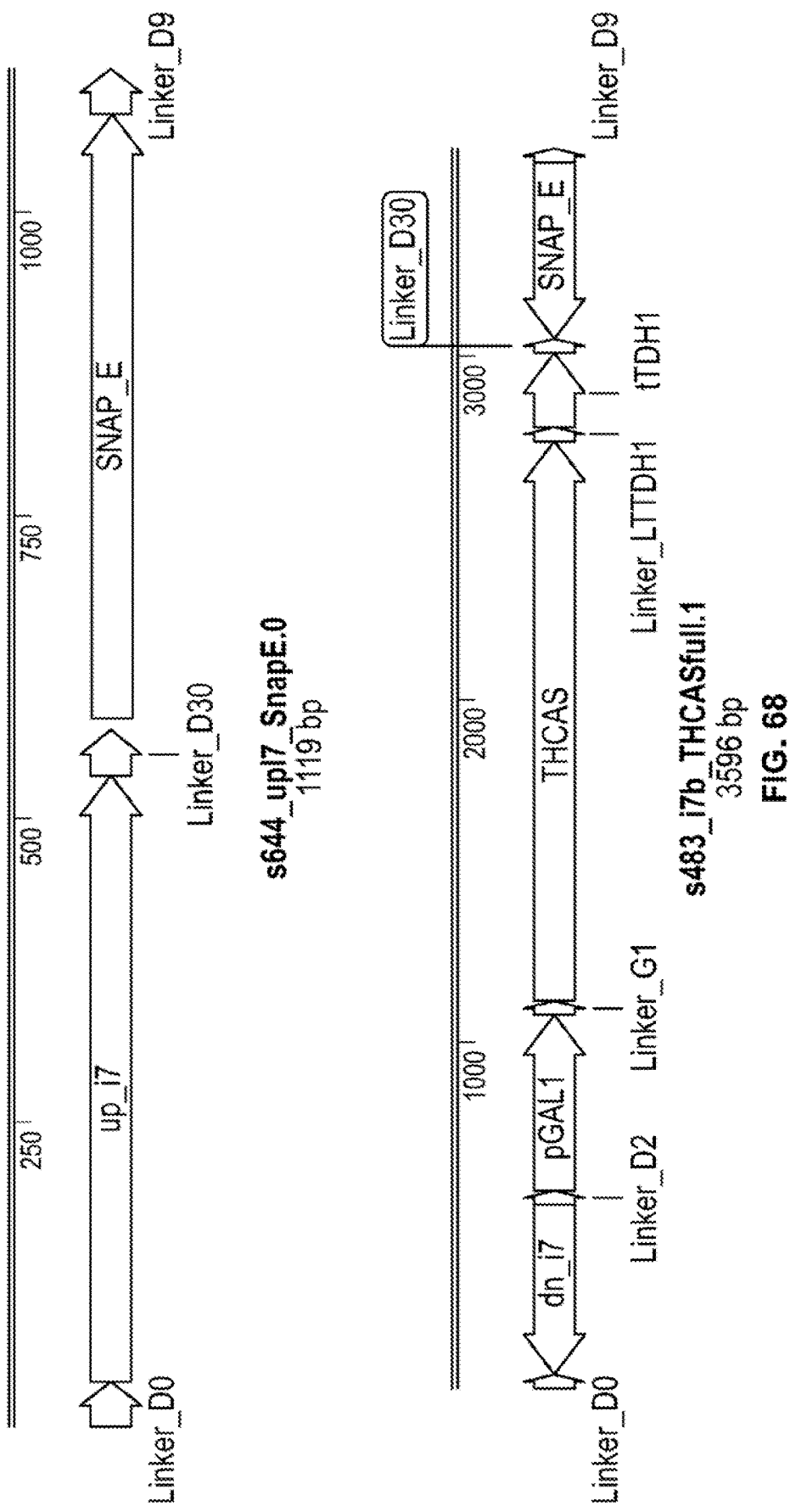
FIG. 68 depicts expression constructs used in the production of the S123 strain.
Figure 69:
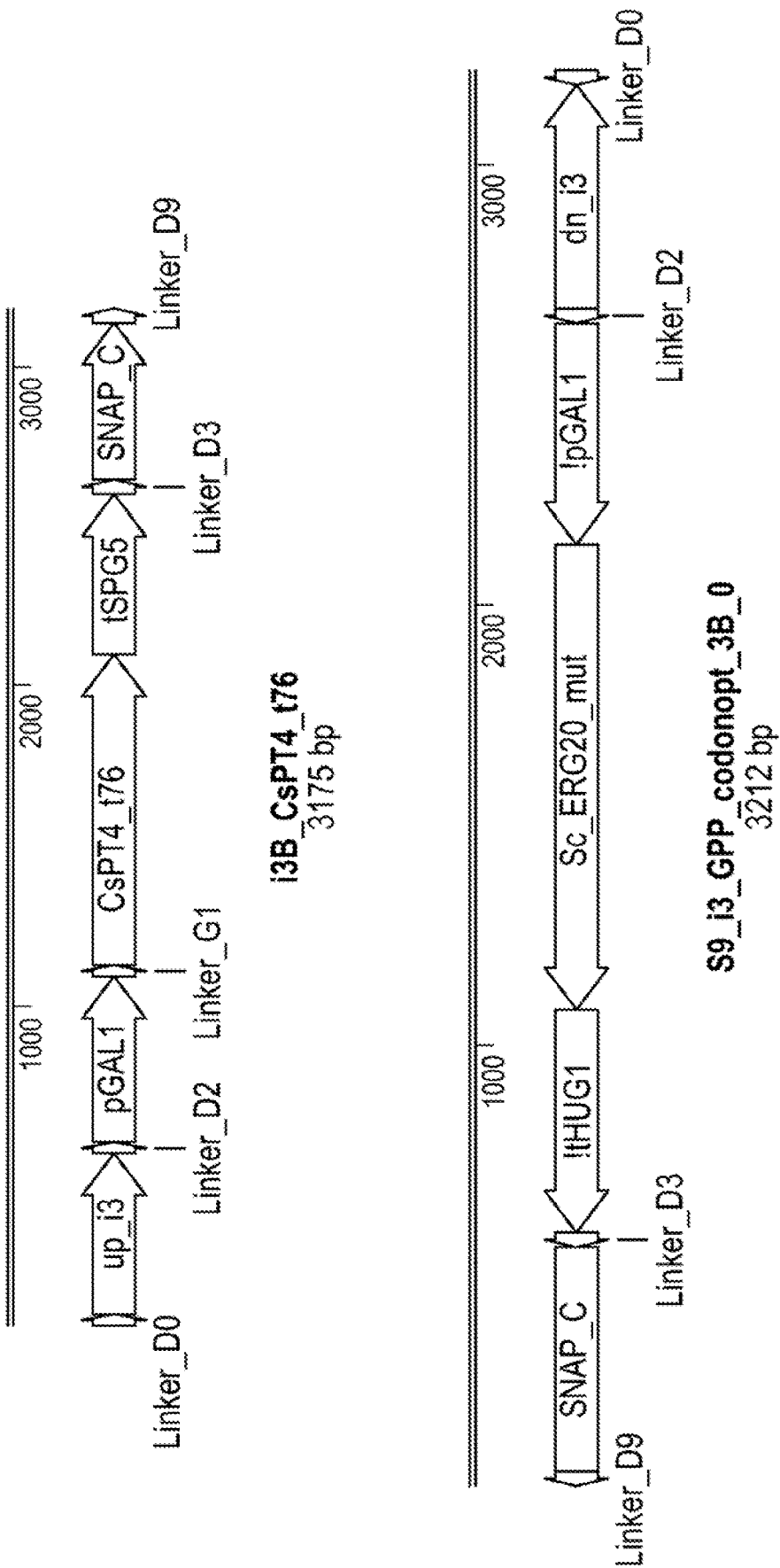
FIG. 69 depicts expression constructs used in the production of the S147 strain.
Figure 70:
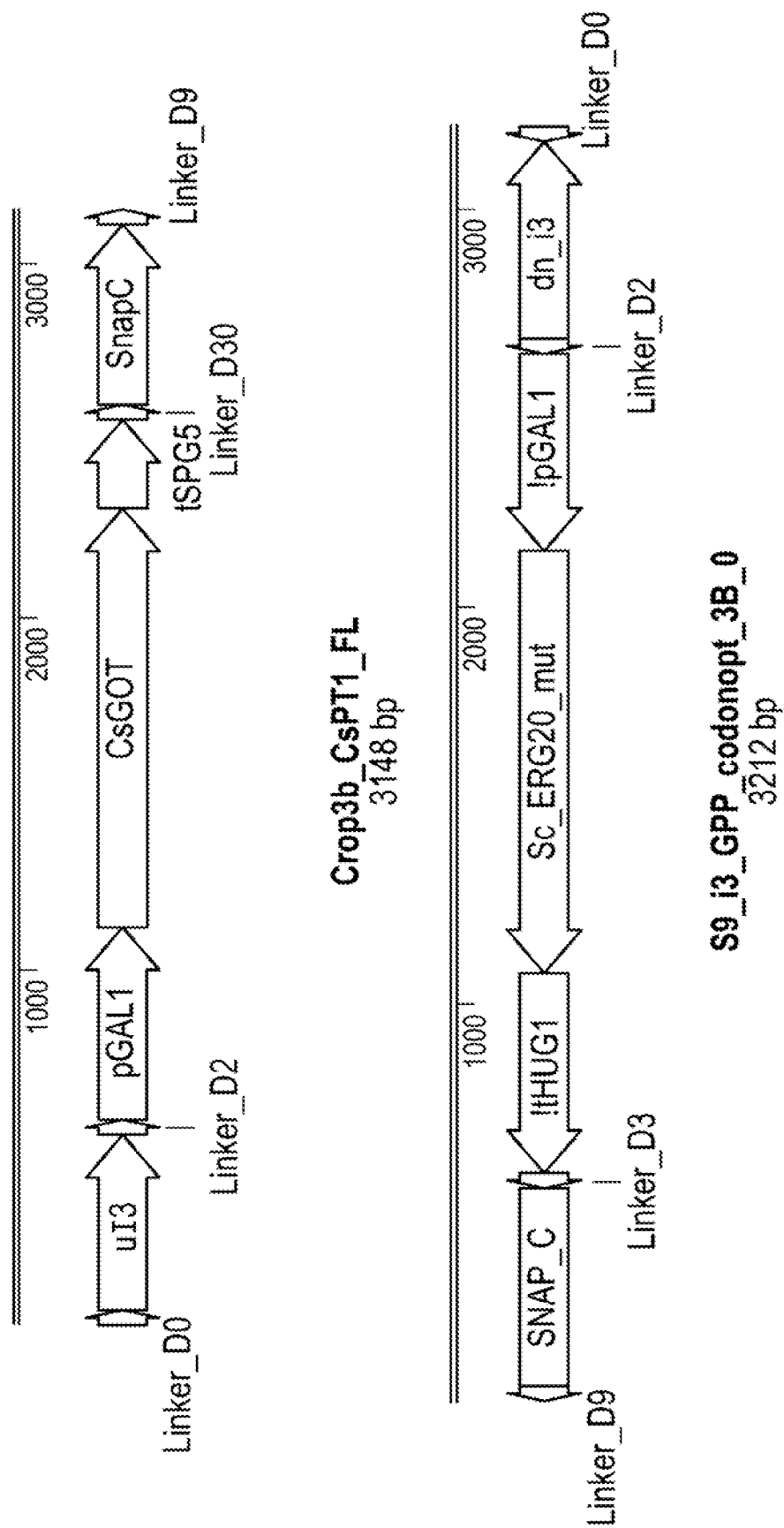
FIG. 70 depicts expression constructs used in the production of the S164 strain.
Figure 71:
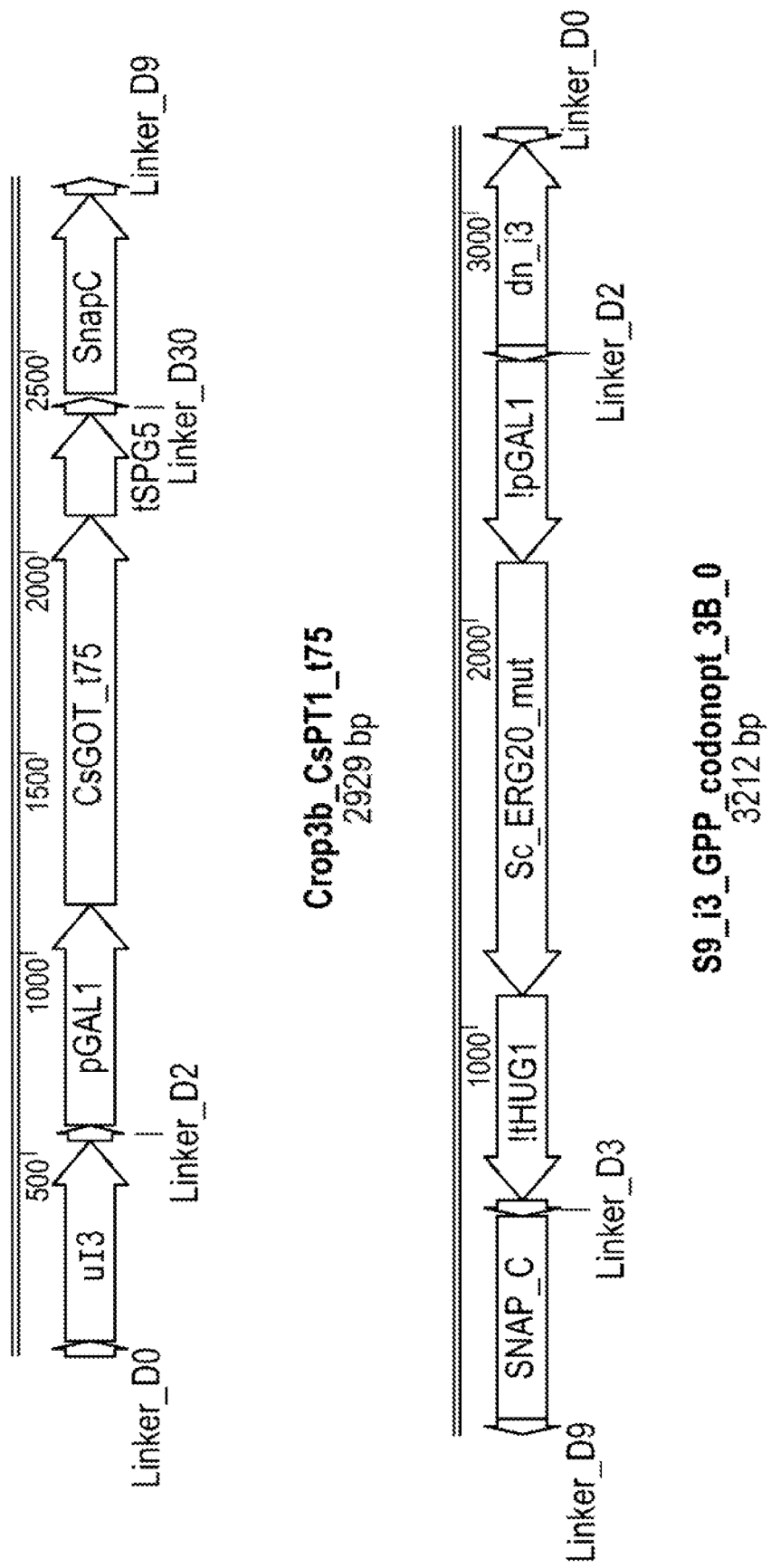
FIG. 71 depicts expression constructs used in the production of the S165 strain.
Figure 72:
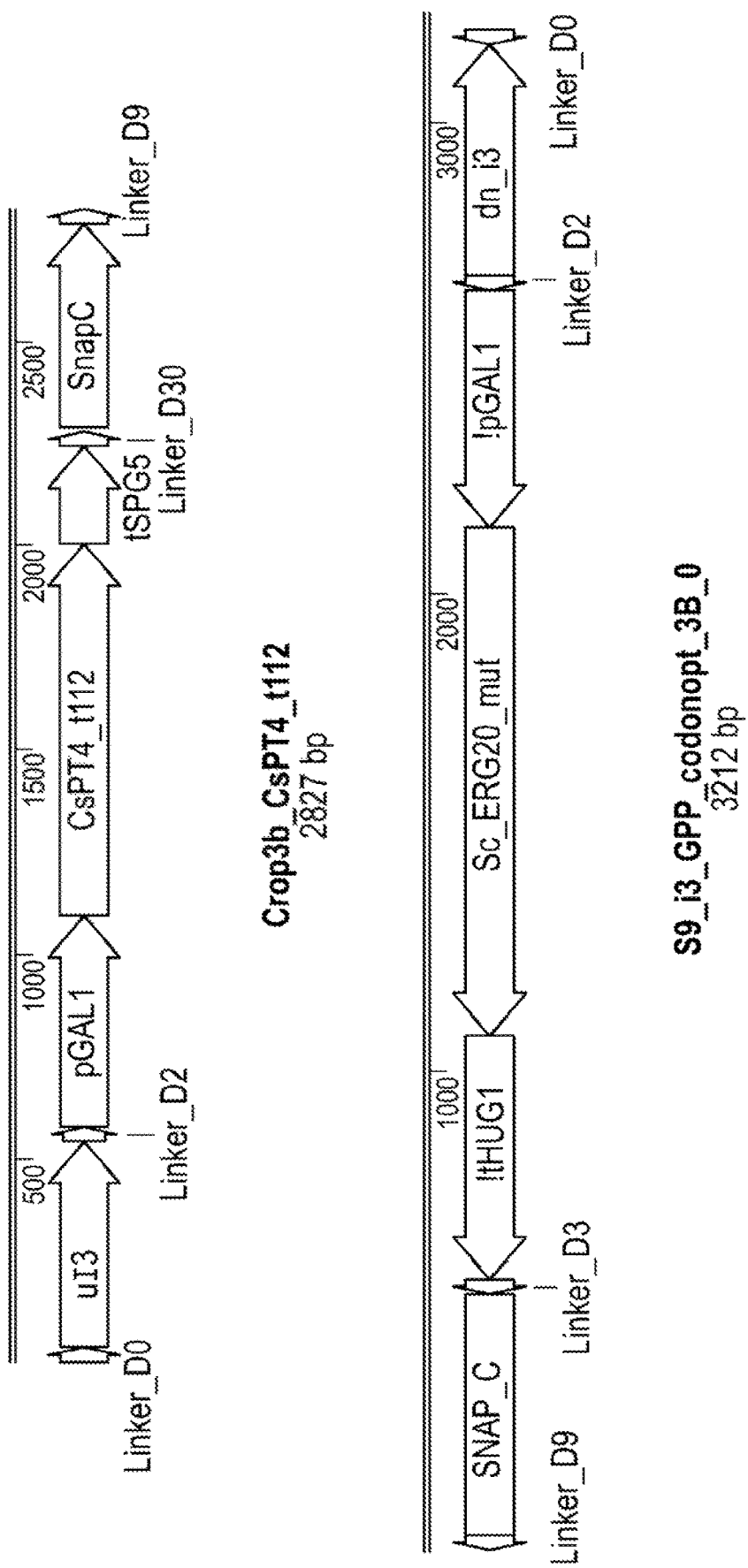
FIG. 72 depicts expression constructs used in the production of the S166 strain.
Figure 73:
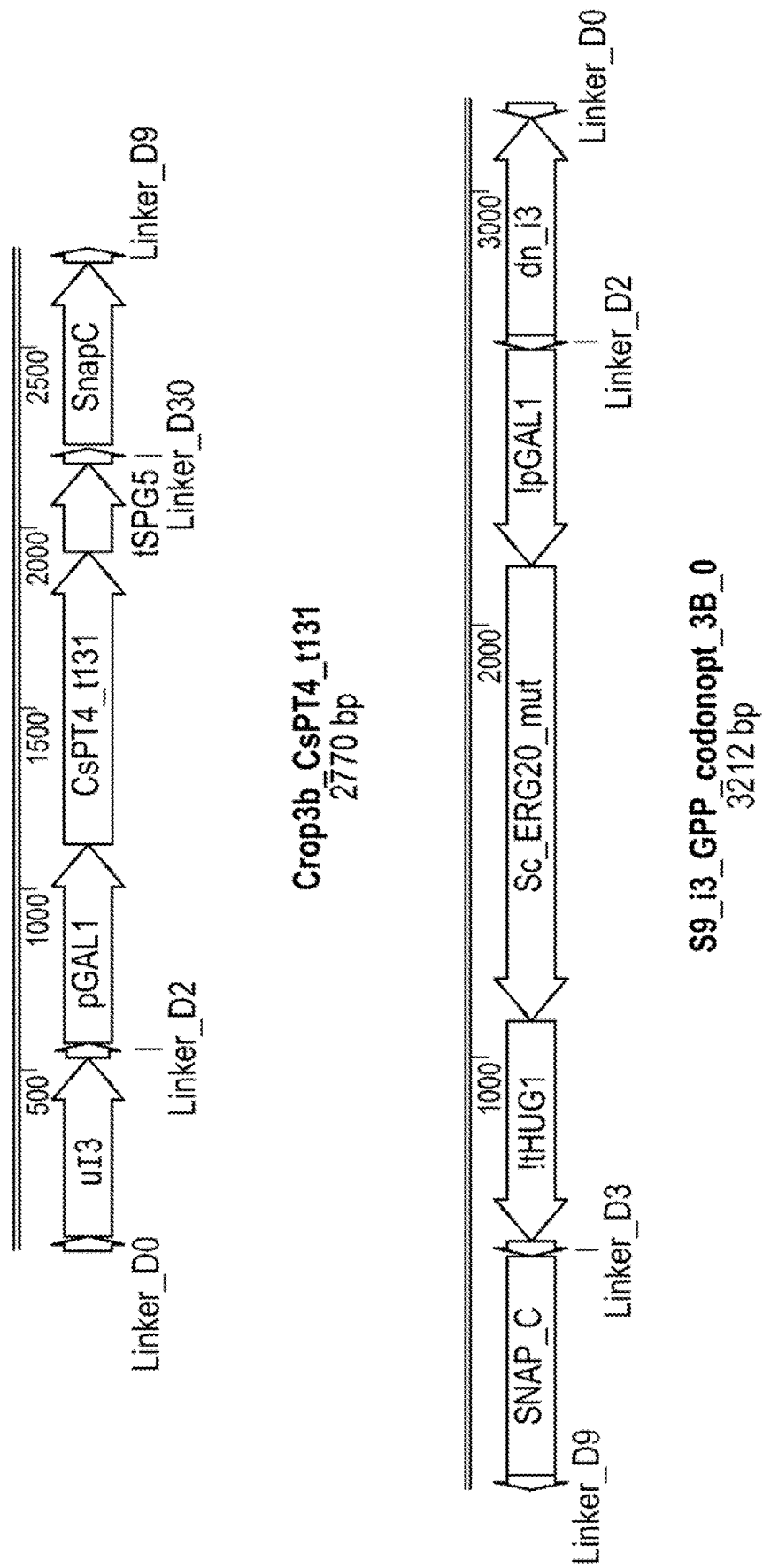
FIG. 73 depicts expression constructs used in the production of the S167 strain.
Figure 74:
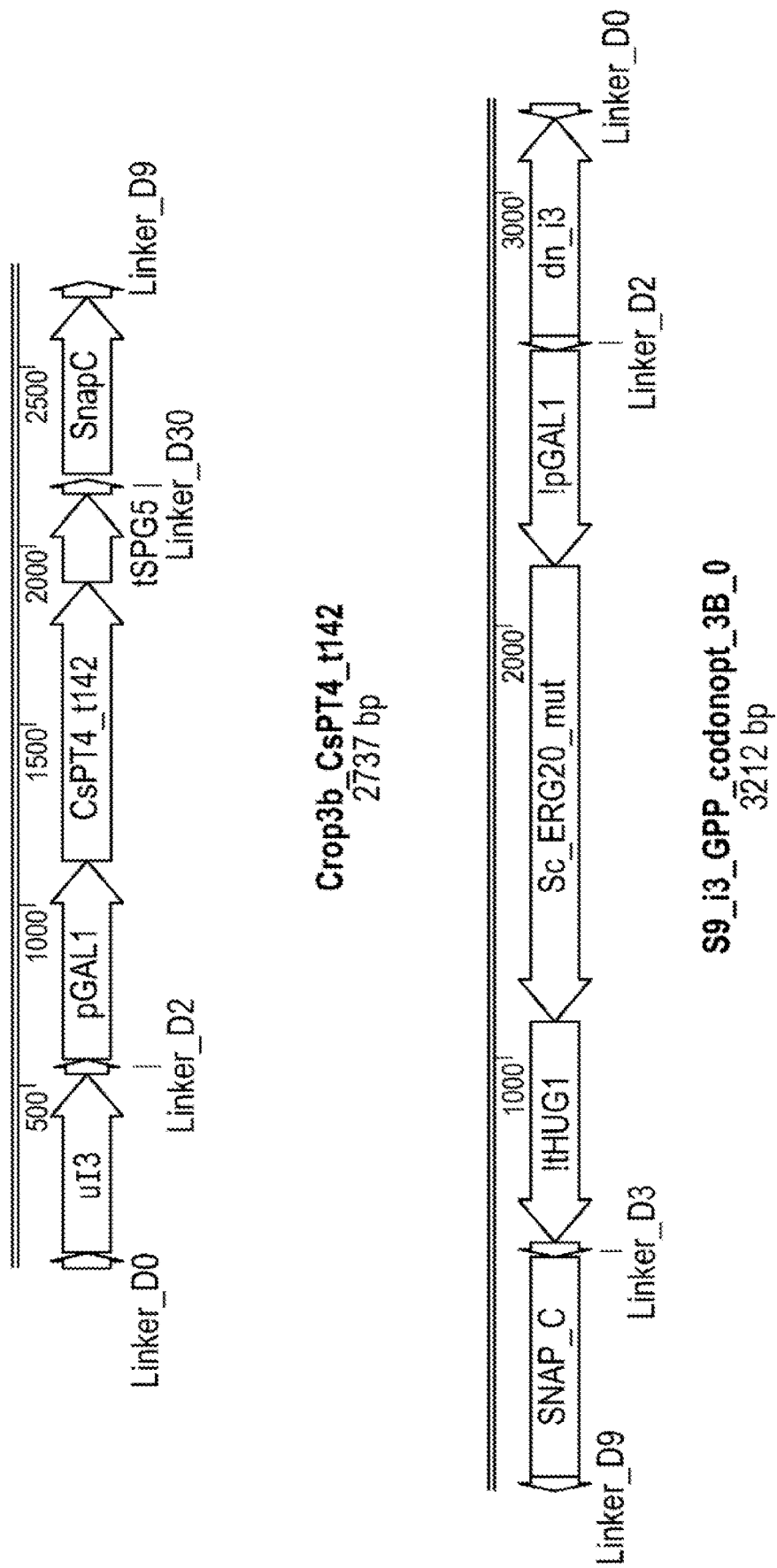
FIG. 74 depicts expression constructs used in the production of the S168 strain.
Figure 75:
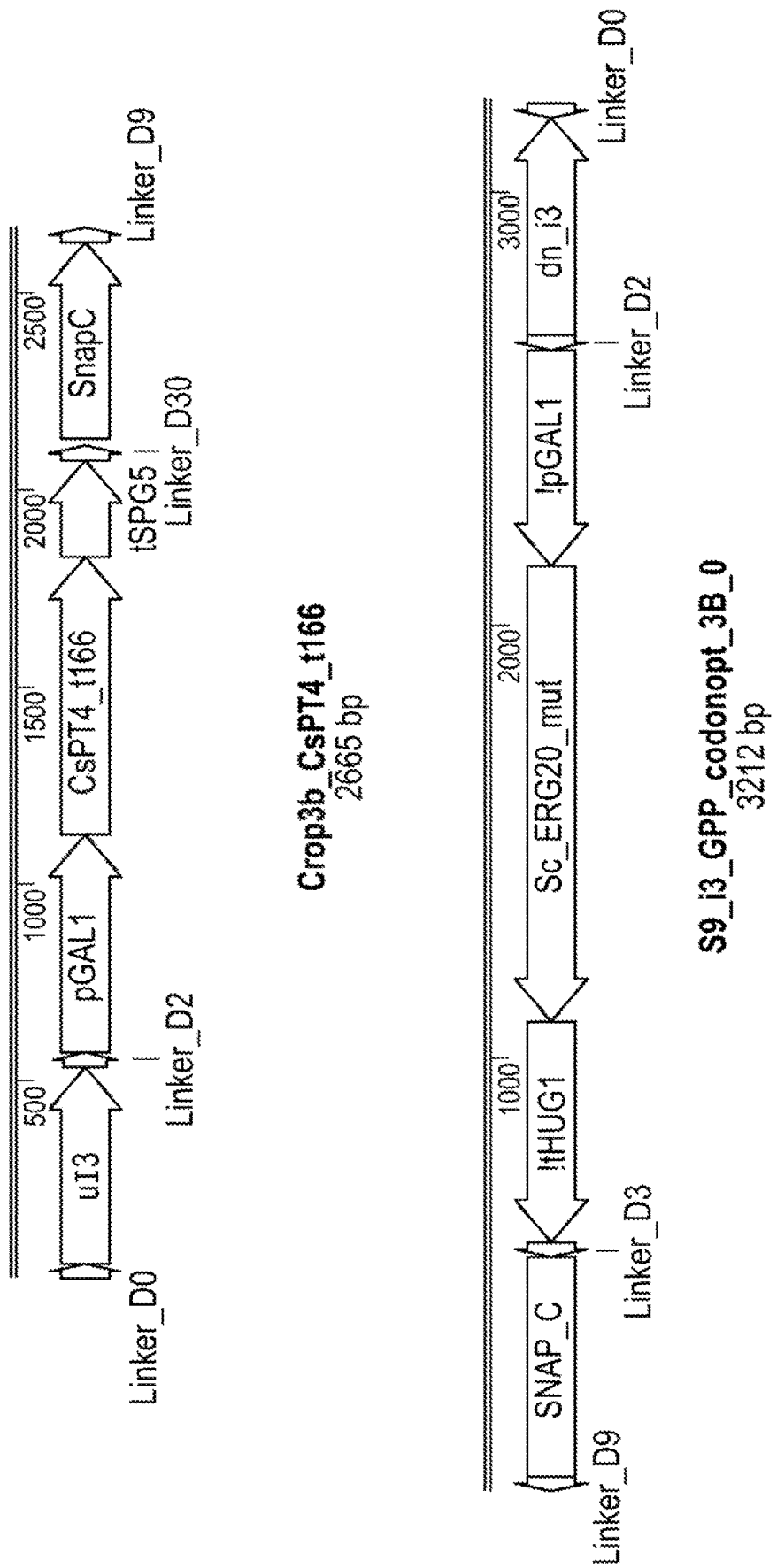
FIG. 75 depicts expression constructs used in the production of the S169 strain.

| Strain (Constructs) | Parent Strain* | Polypeptide SEQ ID NOs (Nucleotide SEQ ID NOs) |
|---|---|---|
| S50 (FIGS. 43A, 43B, and 43C) | S29 | Cs_OAC: SEQ ID NO: 10 (SEQ ID NO: 163)<br>Cs_TKS: SEQ ID NO: 11 (SEQ ID NO: 162)<br>Sc_FAA2: SEQ ID NO: 169 (SEQ ID NO: 168) |
| S51 (FIGS. 44A, 44B, and 44C) | S29 | Cs_OAC: SEQ ID NO: 10 (SEQ ID NO: 163)<br>Cs_TKS: SEQ ID NO: 11 (SEQ ID NO: 162) |
| S78 (FIG. 45) | S51 | Cs_AAE1_v1: SEQ ID NO: 90 (SEQ ID NO: 164)<br>Cs_AAE_v1: SEQ ID NO: 90 (SEQ ID NO: 164)<br>GB1: SEQ ID NO: 174 (SEQ ID NO: 173) |
| S80 (FIG. 46) | S51 | Cs_AAE3: SEQ ID NO: 92 (SEQ ID NO: 166) |
| S81 (FIG. 47) | S51 | Cs_AAE3_Ctrunc: SEQ ID NO: 149 (SEQ ID NO: 150) |
| S82 (FIG. 48) | S51 | Sc_FAA1: SEQ ID NO: 192 (SEQ ID NO: 191)<br>FAA1: SEQ ID NO: 192 (SEQ ID NO: 191) |
| S83 (FIG. 49) | S51 | Sc_FAA2: SEQ ID NO: 169 (SEQ ID NO: 168) |
| S84 (FIG. 50) | S51 | Sc_FAA2_Ctrunc: SEQ ID NO: 194 (SEQ ID NO: 193) |
| S85 (FIG. 51) | S51 | Sc_FAA2_Cmut: SEQ ID NO: 196 (SEQ ID NO: 195)<br>Sc_FAA2: SEQ ID NO: 169 (SEQ ID NO: 168) |
| S86 (FIG. 52) | S51 | Sc_FAA3: SEQ ID NO: 198 (SEQ ID NO: 197) |
| S87 (FIG. 53) | S51 | Sc_FAA4: SEQ ID NO: 200 (SEQ ID NO: 199) |
| S88 (FIG. 54) | S51 | Cs_AAE1_v1: SEQ ID NO: 90 (SEQ ID NO: 164)<br>Sc_ACC1_act: SEQ ID NO: 207 (SEQ ID NO: 201) |
| S89 (FIG. 55) | S51 | Sc_FAA2: SEQ ID NO: 169 (SEQ ID NO: 168)<br>Sc_ACC1_act: SEQ ID NO: 207 (SEQ ID NO: 201) |
| S90 (FIGS. 56A, 56B, and 56C) | S29 | Cs_OAC: SEQ ID NO: 10 (SEQ ID NO: 163)<br>Cs_TKS: SEQ ID NO: 11 (SEQ ID NO: 162)<br>Cs_AAE1_v1: SEQ ID NO: 90 (SEQ ID NO: 164)<br>Cs_AAE_v1: SEQ ID NO: 90 (SEQ ID NO: 164) |
| S91 (FIGS. 57A, 57B, and 57C) | S29 | Cs_OAC: SEQ ID NO: 10 (SEQ ID NO: 163)<br>Cs_TKS: SEQ ID NO: 11 (SEQ ID NO: 162)<br>Sc_FAA2: SEQ ID NO: 169 (SEQ ID NO: 168) |
| S94 (FIG. 58) | S31 | Cs_PT4_full: SEQ ID NO: 110 (SEQ ID NO: 111) |
| S95 (FIG. 59) | S31 | GB1: SEQ ID NO: 174 (SEQ ID NO: 173)<br>Cs_OAC: SEQ ID NO: 10 (SEQ ID NO: 163) |
| S97 (FIG. 60) | S31 | Cs_OAC: SEQ ID NO: 10 (SEQ ID NO: 163)<br>Cs_TKS: SEQ ID NO: 11 (SEQ ID NO: 162)<br>GS12: SEQ ID NO: 172 (SEQ ID NO: 171) |
| S104 (FIG. 61) | S21 | Cs_PT4: SEQ ID NO: 110 (SEQ ID NO: 111)<br>Ag_GPPS: SEQ ID NO: 133 (SEQ ID NO: 134)<br>GB1: SEQ ID NO: 174 (SEQ ID NO: 173) |
| S108 (FIG. 62) | S21 | Cs_PT4: SEQ ID NO: 110 (SEQ ID NO: 111)<br>Hb_GPPS: SEQ ID NO: 143 (SEQ ID NO: 144)<br>GB1: SEQ ID NO: 174 (SEQ ID NO: 173) |
| S112 (FIG. 63) | S21 | Cs_PT4: SEQ ID NO: 110 (SEQ ID NO: 111)<br>Cs_GPPS_NTrunc: SEQ ID NO: 127 (SEQ ID NO: 128) |
| S114 (FIG. 64) | S21 | Cs_PT4: SEQ ID NO: 110 (SEQ ID NO: 111)<br>Pa_GPPS_NTrunc: SEQ ID NO: 131 (SEQ ID NO: 132) |
| S115 (FIG. 65) | S21 | Cs_PT4: SEQ ID NO: 110 (SEQ ID NO: 111)<br>Ag_GPPS_NTrunc: SEQ ID NO: 203 (SEQ ID NO: 202) |
| S116 (FIG. 66) | S21 | Cs_PT4: SEQ ID NO: 110 (SEQ ID NO: 111)<br>Pb_GPPS_NTrunc: SEQ ID NO: 135 (SEQ ID NO: 136) |
| S118 (FIG. 67) | S21 | Cs_PT4: SEQ ID NO: 110 (SEQ ID NO: 111)<br>Es_GPPS_NTrunc: SEQ ID NO: 139 (SEQ ID NO: 140) |
| S123 (FIG. 68) | S29 | Cs_THCAS_full: SEQ ID NO: 155 (SEQ ID NO: 156) |
| S147 (FIG. 69) | S21 | Cs_PT4t: SEQ ID NO: 100 (SEQ ID NO: 224)<br>Sc_ERG20_mut: SEQ ID NO: 60 (SEQ ID NO: 161) |
| S164 (FIG. 70) | S21 | Cs_PT1: SEQ ID NO: 82 (SEQ ID NO: 220)<br>Sc_ERG20_mut: SEQ ID NO: 60 (SEQ ID NO: 161) |
| S165 (FIG. 71) | S21 | CsPT1_t75: SEQ ID NO: 223 (SEQ ID NO: 222)<br>Sc_ERG20_mut: SEQ ID NO: 60 (SEQ ID NO: 161) |
| S166 (FIG. 72) | S21 | CsPT4_t112: SEQ ID NO: 211 (SEQ ID NO: 210)<br>Sc_ERG20_mut: SEQ ID NO: 60 (SEQ ID NO: 161) |
| S167 (FIG. 73) | S21 | CsPT4_t131: SEQ ID NO: 213 (SEQ ID NO: 212)<br>Sc_ERG20_mut: SEQ ID NO: 60 (SEQ ID NO: 161) |
| S168 (FIG. 74) | S21 | CsPT4_t142: SEQ ID NO: 215 (SEQ ID NO: 214)<br>Sc_ERG20_mut: SEQ ID NO: 60 (SEQ ID NO: 161) |
| S169 (FIG. 75) | S21 | CsPT4_t166: SEQ ID NO: 217 (SEQ ID NO: 216)<br>Sc_ERG20_mut: SEQ ID NO: 60 (SEQ ID NO: 161) |

TABLE 11-continued

Constructs and strains used in the Examples

Figure 76:
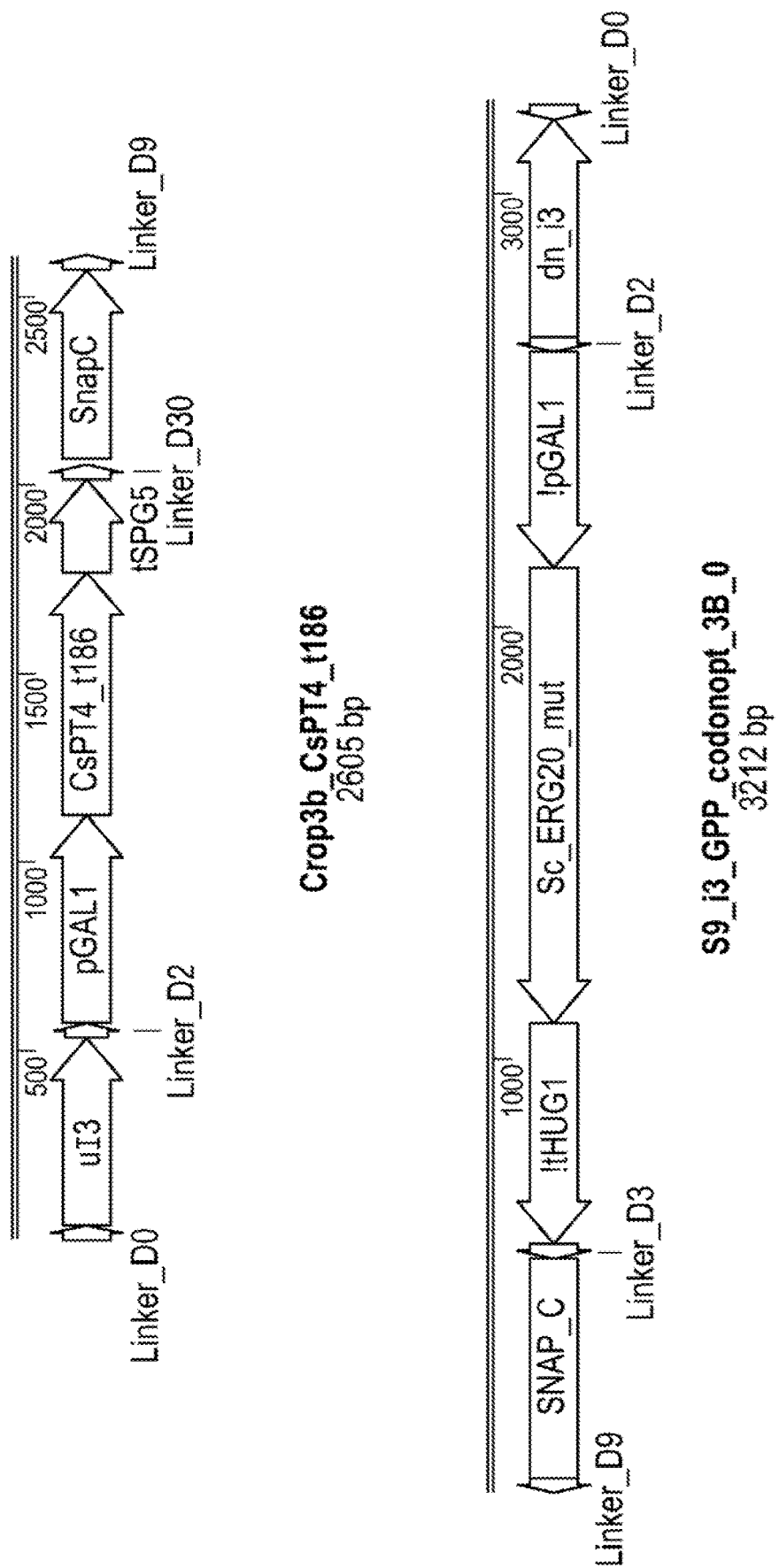
FIG. 76 depicts expression constructs used in the production of the S170 strain.

| Strain (Constructs) | Parent Strain* | Polypeptide SEQ ID NOs (Nucleotide SEQ ID NOs) |
|---|---|---|
| S170 (FIG. 76) | S21 | CsPT4_t186: SEQ ID NO: 219 (SEQ ID NO: 218) Sc_ERG20_mut: SEQ ID NO: 60 (SEQ ID NO: 161) |

*If a strain has a parent strain, it is a child strain. All of the constructs present in the parent strain are also all present in the child strain.

While the present disclosure has been described with reference to the specific embodiments thereof, it should be understood by those skilled in the art that various changes may be made and equivalents may be substituted without departing from the true spirit and scope of the disclosure. In addition, many modifications may be made to adapt a particular situation, material, composition of matter, process, process step or steps, to the objective, spirit and scope of the present disclosure. All such modifications are intended to be within the scope of the claims appended hereto.

SEQUENCE LISTING (225 sequences)

SEQ ID NO: 1 - protein, 776 aa, Cannabis sativa
MALELPHLLPYKLVKGQTLVAQAARAELASSSSSSVILKSNFINNNYINYCNNNNNNERRLVVRRDWETMASSPSHSRNNNDIRTINHLRHVDSMATMPSGAGKIPRLNAVILGEALATEENDLVFPTDEFSQQAHVPSPQKYLEMYKRSIEDPAGFWSEIASQFYWKQKWDDSVYSENLDVSKGRVNIEWFKGGITNICYNCLDKNVEAGLGDKIALYWEGNDTGFDDSLTYSQLLHKVCQLANYLKDMGVQKGDAVVIYLPMLLELPITMLACARIGAVHSVVFAGFSAESLSQRIIDCKPKVVITCNAVKRGPKIIHLKDIVDAALVESAKTGVPIDTCLVYENQLAMKRDITKWQDGRDIWWQDVIPKYPTECAVEWVDAEDPLFLLYTSGSTGKPKGVLHTTGGYMVYTATTFKYAFDYKPSDVYWCTADCGWITGHSYVTYGPLLNGASCIVFEGAPNYPDSGRCWDIVDKYKVTIFYTAPTLVRSLMRDGDEYVTRYSRKSLRILGSVGEPINPSAWRWFYNVVGDSRCPISDTWWQTETGGFMITPLPGAWPQKPGSATFPFFGVKPVIVDEKGVEIEGECSGYLCVKGSWPGAFRTLYGDYERYETTYFKPFTGYYFTGDGCSRDKDGYHWLTGRVDDVINVSGHRIGTAEVESALVSHPKCAEAAVVGIEHEVKGQAIYAFVTLVEGEPYSEELRKSLILSVRKQIGAFAAPERIHWAPGLPKTRSGKIMRRILRKIASGQLDELGDTSTLADPNVVEQLISLSNC

SEQ ID NO: 2 - protein, 579 aa, Streptomyces sp.
MELALPAELAPTLPEALRLRSEQQPDTVAYVFLRDGETPEETLTYGRLDRAARARAAALEAAGLAGGTAVLLYPSGLEFVAALLGCMYAGTAGAPVQVPTRRRGMERARRIADDAGAKTILTTTAVKREVEEHFADLLTGLTVIDTESLPDVPDDAPAVRLPGPDDVALLQYTSGSTGDPKGVEVTHANFRANVAETVELWPVRSDGTVVNWLPLFHDMGLMFGVVMPLFTGVPAYLMAPQSFIRRPARWLEAISRFRGTHAAAPSFAYELCVRSVADTGLPAGLDLSSWRVAVNGAEPVRWTAVADFTEAYAPAGFRPQAMCPGYGLAENTLKLSGSPEDRPPTLLRADAAALQDGRVVPLTGPGTDGVRLVGSGVTVPSSRVAVVDPGTGTEQPAGRVGEIWINGPCVARGYHGRPAESAESFGARIAGQEARGTWLRTGDLGFLHDGEVFVAGRLKDVVIHQGRNFYPQDIELSAEVSDRALHPNCAAAFALDDGRTERLVLLVEADGRALRNGGADALRARVHDAVWDRQRLRIDEIVLLRRGALPKTSSGKVQRRLARSRYLDGEFGPAPAREA

SEQ ID NO: 3 - protein, 1671 aa, Aspergillus sp.
MVIQGKRLAASSIQLLASSLDAKKLCYEYDERQAPGVTQITEEAPTEQPPLSTPPSLPQTPNISPISASKIVIDDVALSRVQIVQALVARKLKTAIAQLPTSKSIKELSGGRSSLQNELVGDIHNEFSSIPDAPEQILLRDFGDANPTVQLGKTSSAAVAKLISSKMPSDFNANAIRAHLANKWGLGPLRQTAVLLYAIASEPPSRLASSSAAEEYWDNVSSMYAESCGITLRPRQDTMNEDAMASSAIDPAVVAEFSKGHRRLGVQQFQALAEYLQIDLSGSQASQSDALVAELQQKVDLWTAEMTPEFLAGISPMLDVKKSRRYGSWWNMARQDVLAFYRRPSYSEFVDDALAFKVFLNRLCNRADEALLNMVRSLSCDAYFKQGSLPGYHAASRLLEQAITSTVADCPKARLILPAVGPHTTITKDGTIEYAEAPRQGVSGPTAYIQSLRQGASFIGLKSADVDTQSNLTDALLDAMCLALHNGISFVGKTFLVTGAGQGSIGAGVVRLLLEGGARVLVTTSREPATTSRYFQQMYDNHGAKFSELRVVPCNLASAQDCEGLIRHVYDPRGLNWDLDAILPFAAASDYSTEMHDIRGQSELGHRLMLVNVFRVLGHIVHCKRDAGVDCHPTQVLLPLSPNHGIFGGDGMYPESKLALESLFHRIRSESWSDQLSICGVRIGWTRSTGLMTAHDIIAETVEEHGIRTFSVAEMALNIAMLLTPDFVAHCEDGPLDADFTGSLGTLGSIPGFLAQLHQKVQLAAEVIRAVQAEDEHERFLSPGTKPTLQAPVAPMHPRSSLRVGYPRLPDYEQEIRPLSPRLERLQDPANAVVVVGYSELGPWGSARLRWEIESQGQWTSAGYVELAWLMNLIRHVNDESYVGWVDTQTGKPVRDGEIQALYGDHIDNHTGIRPIQSTSYNPERMEVLQEVAVEEDLPEFEVSQLTADAMRLRHGANVSIRPSGNPDACHVKLKRGAVILVPKTVPFVWGSCAGELPKGWTPAKYGIPENLIHQVDPVTLYTICCVAEAFYSAGITHPLEVFRHIHLSELGNFIGSSMGGPTKTRQLYRDVYFDHEIPSDVLQDTYLNTPAAWVNMLLLGCTGPIKTPVGACATGVESIDSGYESIMAGKTKMCLVGGYDDLQEEASYGFAQLKATVNVEEEIACGRQPSEMSRPMAESRAGFVEAHGCGVQLLCRGDIALQMGLPIYAVIASSAMAADKIGSSVPAPGQGILSFSRERARSSMISVTSRPSSRSSTSSEVSDKSSLTSITSISNPAPRAQRARSTTDMAPLRAALATWGLTIDDLDVASLHGTSTRGNDLNEPEVIETQMRHLGRTPGRPLWAICQKSVTGHPKAPAAAWMLNGCLQVLDSGLVPGNRNLDTLDEALRSASHLCFPTRTVQLREVKAFLLTSFGFGQKGGQVVGVAPKYFFATLPRPEVEGYYRKVRVRTEAGDRAYAAAVMSQAVVKIQTQNPYDEPDAPRIFLDPLARISQDPSTGQYRFRSDATPALDDDALPPPGEPTELVKGISSAWIEEKVRPHMSPGGTVGVDLVPLASFDAYKNAIFVERNYTVRERDWAEKSADVRAAYASRWCAKEAVFKCLQTHSQGAGAAMKEIEIEHGGNGAPKVKLRGAAQTAARQRGLEGVQLSISYGDDAVIAVALGLMSGAS

SEQ ID NO: 4 - protein, 1888 aa, Aspergillus sp.
MGSVSREHESIPIQAAQRGAARICAAFGGQGSNNLDVLKGLLELYKRYGPDLDELLDVASNTLSQLASSPAAIDVHEPWGFDLRQWLTTPEVAPSKEILALPPRSFPLNTLLSLALYCATCRELELDPGQFRSLLHSSTGHSQGILAAVAITQAESWPTFYDACRTVLQISFWIGLEAYLFTPSSAASDAMIQDCIEHGEGLLSSMLSVSGLSRSQVERVIEHVNKGLGECNRWVHLALVNSHEKFVLAGPPQSLWAVCLHVRRIRADNDLDQSRILFRNRKPIVDILFLPISAPFHTPYLDGVQDRVIEALSSASLALHSIKIPLYHTGTGSNLQELQPHQLIPTLIRAITVDQLDWPLVCRGLNATHVLDFGPGQTCSLIQELTQGTGVSVIQLTTQSGPKPVGGHLAAVNWEAEFGLRLHANVHGAAKLHNRMTTLLGKPPVMVAGMTPTTVRWDFVAAVAQAGYHVELAGGGYHAERQFEAEIRRLATAIPADHGITCNLLYAKPTTFSWQISVIKDLVRQGVPVEGITIGAGIPSPEVVQECVQSIGLKHISFKPGSFEAIHQVIQIARTHPNFLIGLQWTAGRGGGHHSWEDFHGPILATYAQIRSCPNILLVVGSGFGGGPDTFPYLTGQWAQAFGYPCMPFDGVLLGSRMMVAREAHTSAQAKRLIIDAQGVGDADWHKSFDEPTGGVVTVNSEFGQPIHVLATRGVMLWKELDNRVFSIKDTSKRLEYLRNHRQEIVSRLNADFARPWFAVDGHGQNVELEDMTYLEVLRRLCDLTYVSHQKRWVDPSYRILLLDFVHLLRERFQCAIDNPGEYPLDIIVRVEESLKDKAYRTLYPEDVSLLMHLFSRRDIKPVPFIPRLDERFETWFKKDSLWQSEDVEAVIGQDVQRIFIIQGPMAVQYSISDDESVKDILHNICNHYVEALQADSRETSIGDVHSITQKPLSAFPGLKVTTNRVQGLYKFEKVGAVPEMDVLFEHIVGLSKSWARTCLMSKSVFRDGSRLHNPIRAALQLQRGDTIEVLLTADSEIRKIRLISPTGDGGSTSKVVLEIVSNDGQRVFATLAPNIPLSPEPSVVFCFKVDQKPNEWTLEEDASGRAERIKALYMSLWNLGFPNKASVLGLNSQFTGEELMITTDKIRDFERVLRQTSPLQLQSWNPQGCVPIDYCVVIAWSALTKPLMVSSLKCDLLDLLHSAISFHYAPSVKPLRVGDIVKTSSRILAVSVRPRGTMLTVSADIQRQGQHVVTVKSDFFLGGPVLACETPFELTEEPEMVVHVDSEVRRAILHSRKWLMREDRALDLLGRQLLFRLKSEKLFRPDGQLALLQVTGSVFSYSPDGSTTAFGRVYFESESCTGNVVMDFLHRYGAPRAQLLELQHPGWTGTSTVAVRGPRRSQSYARVSLDHNPIHVCPAFARYAGLSGPIVHGMETSAMMRRIAEWAIGDADRSRFRSWHITLQAPVHPNDPLRVELQHKAMEDGEMVLKVQAFNERTEERVAEADAHVEQETTAYVFCGQGSQRQGMGMDLYVNCPEAKALWARADKHLWEKYGFSILHIVQNNPPALTVHFGSQRGRRIRANYLRMMGQPPIDGRHPPILKGLTRNSTSYTFSYSQGLLMSTQFAQPALALMEMAQFEWLKAQGVVQKGARFAGHSLGEYAALGACASFLSFEDLISLIFYRGLKMQNALPRDANGHTDYGMLAADPSRIGKGFEEASLKCLVHIIQQETGWFVEVVNYNINSQQYVCAGHFRALWMLGKICDDLSCHPQPETVEGQELRAMVWKHVPTVEQVPREDRMERGRATIPLPGIDIPYHSTMLRGEIEPYREYLSERIKVGDVKPCELVGRWIPNVVGQPFSVDKSYVQLVHGITGSPRLHSLLQQMA

SEQ ID NO: 5 - protein, 377 aa, Mentha x piperita
MSALVNPVAKWPQTIGVKDVHGGRRRRSRSTLFQSHPLRTEMPFSLYFSSPLKAPATFSVSAVYTKEGSEIRDKDPAPSTSPAFDFDGYMLRKAKSVNKALEAAVQMKEPLKIHESMRYSLLAGGKRVRPMLCIAACELVGGDESTAMPAACAVEMIHTMSLMHDDLPCMDNDDLRRGKPTNHMAFGESVAVLAGDALLSFAFEHVAAATKGAPPERIVRVLGELAVSIGSEGLVAGQVVDVCSEGMAEVGLDHLEFIHHHKTAALLQGSVVLGAILGGGKEEEVAKLRKFANCIGLLFQVVDDILDVTKSSKELGKTAGKDLVADKTTYPKLIGVEKSKEFADRLNREAQEQLLHFHPHRAAPLIALANYIAYRDN

SEQ ID NO: 6 - protein, 313 aa, Mentha x piperita
MAINLSHINSKTCFPLKTRSDLSRSSSARCMPTAAAAAFPTIATAAQSQPYWAAIEADIERYLKKSITIRPPETVFGPMHHLTFAAPATAASTLCLAACELVGGDRSQAMAAAAAIHLVHAAAYVHEHLPLTDGSRPVSKPAIQHKYGPNVELLTGDGIVPFGFELLAGSVDPARTDDPDRILRVIIEISRAGGPEGMISGLHREEEIVDGNTSLDFIEYVCKKKYGEMHACGAACGAILGGAAEEEIQKLRNFGLYQGTLRGMMEMKNSHQLIDENIIGKLKELALEELGGFHGKNAELMSSLVAEPSLYAA

SEQ ID NO: 7 - protein, 352 aa, Saccharomyces sp.
MASEKEIRRERFLNVFPKLVEELNASLLAYGMPKEACDWYAHSLNYNTPGGKLNRGLSVVDTYAILSNKTVEQLGQEEYEKVAILGWCIELLQAYFLVADDMMDKSITRRGQPCWYKVPEVGEIAINDAFMLEAAIYKLLKSHFRNEKYYIDITELFHEVTFQTELGQLMDLITAPEDKVDLSKFSLKKHSFIVTFKTAYYSFYLPVALAMYVAGITDEKDLKQARDVLIPLGEYFQIQDDYLDCFGTPEQIGKIGTDIQDNKCSWVINKALELASAEQRKTLDENYGKKDSVAEAKCKKIFNDLKIEQLYHEYEESIAKDLKAKISQVDESRGFKADVLTAFLNKVYKRSK

SEQ ID NO: 8 - protein, 352 aa, Artificial Sequence
  Mutated Erg20 farnesylpyrophosphate synthase (K197G)
MASEKEIRRERFLNVFPKLVEELNASLLAYGMPKEACDWYAHSLNYNTPGGKLNRGLSVVDTYAILSNKTVEQLGQEEYEKVAILGWCIELLQAYFLVADDMMDKSITRRGQPCWYKVPEVGEIAINDAFMLEAAIYKLLKSHFRNEKYYIDITELFHEVTFQTELGQLMDLITAPEDKVDLSKFSLKKHSFIVTFGTAYYSFYLPVALAMYVAGITDEKDLKQARDVLIPLGEYFQIQDDYLDCFGTPEQIGKIGTDIQDNKCSWVINKALELASAEQRKTLDENYGKKDSVAEAKCKKIFNDLKIEQLYHEYEESIAKDLKAKISQVDESRGFKADVLTAFLNKVYKRSK

SEQ ID NO: 9 - protein, 496 aa, Rhizophagus irregularis
MRAQAHLGGGLKRIETQHQKGKLTARERAELLLDPGSFNEYDTFVEHQCTDFGMDKNKIIGDGVVTGHGTINGRRVFTFSQDFTAFGGSLSKMHAQKICKIMDKAMLVGAPVIGLNDSGGARIQEGVDSLAGYADIFQRNVLSSGVVPQLSLIMGPCAGGAVYSPALTDFTFMVRDTSYLFVTGPEVVKAVCNEDVTQEELGGANTHTVISGVAHAAFENDIEAIQRIRDFMDFLPLSNREQAPTRYSDDPIDREDPSLNHIIPVDSTKAYDMREIITRLIDDGHFFEIMPDYAKNIVVGFARMGGKTVSIVGNQPLVSSGVLDINSSVKAARFVRFCDAFNIPIITLVDVPGFLPGTAQEHNGIIRHGAKLLYAYAEATVPKITIITRKAYGGAYDVMSSKHLRGDMNYSWPTGEIAVMGAKGAVEIIFRHVEDRTQSEHEYIDKFANPIPAAQRGYIDDIILPAATRKRIIEDLFVLSHKQLPLIYKKHDNCPL

SEQ ID NO: 10 - protein, 101 aa, Cannabis sativa
MAVKHLIVLKFKDEITEAQKEEFFKTYVNLVNIIPAMKDVYWGKDVTQKNKEEGYTHIVEVTFESVETIQDYIIHPAHVGFGDVYRSFWEKLLIFDYTPRK

SEQ ID NO: 11 - protein, 385 aa, Cannabis sativa
MNHLRAEGPASVLAIGTANPENILLQDEFPDYYFRVTKSEHMTQLKEKFRKICDKSMIRKRNCFLNEEHLKQNPRLVEHEMQTLDARQDMLVVEVPKLGKDACAKAIKEWGQPKSKITHLIFTSASTTDMPGADYHCAKLLGLSPSVKRVMMYQLGCYGGGTVLRIAKDIAENNKGARVLAVCCDIMACLFRGPSESDLELLVGQAIFGDGAAAVIVGAEPDESVGERPIFELVSTGQTILPNSEGTIGGHIREAGLIFDLHKDVPMLISNNIEKCLIEAFTPIGISDWNSIFWITHPGGKAILDKVEEKLHLKSDKFVDSRHVLSEHGNMSSSTVLFVMDELRKRSLEEGKSTTGDGFEWGVLFGFGPGLTVERVVVRSVPIKY

SEQ ID NO: 12 - protein, 327 aa, Artificial Sequence
  Truncated geranyl pyrophosphate olivetolic acid geranyltransferase (GOT)
MNSIRAATTNQTEPPESDNHSVATKILNFGKACWKLQRPYTIIAFTSCACGLFGKELLHNTNLISWSLMFKAFFFLVAILCIASFTTTINQIYDLHIDRINKPDLPLASGEISVNTAWIMSIIVALFGLIITIKMKGGPLYIFGYCFGIFGGIVYSVPPFRWKQNPSTAFLLNFLAHIITNFTFYYASRAALGLPFELRPSFTFLLAFMKSMGSALALIKDASDVEGDTKFGISTLASKYGSRNLTLFCSGIVLLSYVAAILAGIIWPQAFNSNVMLLSHAILAFWLILQTRDFALTNYDPEAGRRFYEFMWKLYYAEYLVYVFIGS

SEQ ID NO: 13 - protein, 332 aa, Artificial Sequence
  Engineered geranyl pyrophosphate olivetolic acid geranyltransferase (GOT)
MKDQRGNSIRASAQIEDRPPESGNLSALTNVKDFVSVCWEYVRPYTAKGVIICSSCLFGRELLENPNLFSWPLIFKAFFFLVAILCIASFTTTINQIYDLHIDRINKPDLPLASGEISVNTAWIMSIIVALFGLIITIKMKGGPLYIFGYCFGIFGGIVYSVPPFRWKQNPSTAFLLNFLAHIITNFTFYYASRAALGLPFELRPSFTFLLAFMKSMGSALALIKDASDVEGDTKFGISTLASKYGSRNLTLFCSGIVLLSYVAAILAGIIWPQAFNSNVMLLSHAILAFWLILQTRDFALTNYDPEAGRRFYEFMWKLYYAEYLVYVFIGS

SEQ ID NO: 14 - protein, 547 aa, Artificial Sequence
  Mutant tetrahydro cannabinolic acid synthase (THCAS)
MNCSAFSFWFVCKIIFFFLSFHIQISIANPRENFLKCFSKHIPNNVANPKLVYTQHDQLYMSILNSTIQNLRFISDTTPKPLVIVTPSNNSHIQATILCSKKVGLQIRTRSGGHDAEGMSYISQVPFVVVDLRNMHSIKIDVHSQTAWVEAGATLGEVYYWINEKNENLSFPGGYCPTVGVGGHFSGGGYGALMRNYGLAADNIIDAHLVNVDGKVLDRKSMGEDLFWAIRGGGGENFGIIAAWKIKLVAVPSKSTIFSVKKNMEIHGLVKLFNKWQNIAYKYDKDLVLMTHFITKNITDNHGKNKTTVHGYFSSIFHGGVDSLVDLMNKSFPELGIKKTDCKEFSWIDTTIFYSGVVNFNTANFKKEILLDRSAGKKTAFSIKLDYVKKPIPETAMVKILEKLYEEDVGAGMYVLYPYGGIMEEISESAIPFPHRAGIMYELWYTASWEKQEDNEKHINWVRSVYNFTTPYVSQNPRLAYLNYRDLDLGKTNHASPNNYTQARIWGEKYFGKNFNRLVKVKTKVDPNNFFRNEQSIPPLPPHHHGS

SEQ ID NO: 15 - protein, 520 aa, Artificial Sequence
  Truncated tetrahydro cannabinolic acid synthase (THCAS)
MNPRENFLKCFSKHIPNNVANPKLVYTQHDQLYMSILNSTIQNLRFISDTTPKPLVIVTPSNNSHIQATILCSKKVGLQIRTRSGGHDAEGMSYISQVPFVVVDLRNMHSIKIDVHSQTAWVEAGATLGEVYYWINEKNENLSFPGGYCPTVGVGGHFSGGGYGALMRNYGLAADNIIDAHLVNVDGKVLDRKSMGEDLFWAIRGGGGENFGIIAAWKIKLVAVPSKSTIFSVKKNMEIHGLVKLFNKWQNIAYKYDKDLVLMTHFITKNITDNHGKNKTTVHGYFSSIFHGGVDSLVDLMNKSFPELGIKKTDCKEFSWIDTTIFYSGVVNFNTANFKKEILLDRSAGKKTAFSIKLDYVKKPIPETAMVKILEKLYEEDVGAGMYVLYPYGGIMEEISESAIPFPHRAGIMYELWYTASWEKQEDNEKHINWVRSVYNFTTPYVSQNPRLAYLNYRDLDLGKTNHASPNNYTQARIWGEKYFGKNFNRLVKVKTKVDPNNFFRNEQSIPPLPPHHHGS

SEQ ID NO: 16 - protein, 519 aa, Artificial Sequence
  Truncated cannabidiolic acid synthase (CBDAS)
MNPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRHGS

SEQ ID NO: 17 - protein, 502 aa, Artificial Sequence
  Truncated 3-hydroxy-3-methyl-glutaryl-CoA reductase (HMGR)
MVLTNKTVISGSKVKSLSSAQSSSSGPSSSSEEDDSRDIESLDKKIRPLEELEALLSSGNTKQLKNKEVAALVIHGKLPLYALEKKLGDTTRAVAVRRKALSILAEAPVLASDRLPYKNYDYDRVFGACCENVIGYMPLPVGVIGPLVIDGTSYHIPMATTEGCLVASAMRGCKAINAGGGATTVLTKDGMTRGPVVRFPTLKRSGACKIWLDSEEGQNAIKKAFNSTSRFARLQHIQTCLAGDLLFMRFRTTTGDAMGMNMISKGVEYSLKQMVEEYGWEDMEVVSVSGNYCTDKKPAAINWIEGRGKSVVAEATIPGDVVRKVLKSDVSALVELNIAKNLVGSAMAGSVGGFNAHAANLVTAVFLALGQDPAQNVESSNCITLMKEVDGDLRISVSMPSIEVGTIGGGTVLEPQGAMLDLLGVRGPHATAPGTNARQLARIVACAVLAGELSLCAALAAGHLVQSHMTHNRKPAEPTKPNNLDATDINRLKDGSVTCIKS

SEQ ID NO: 18 - protein, 284 aa, Ralstonia sp.
MSIRTVGIVGAGTMGNGIAQACAVVGLNVVMVDISDAAVQKGVATVASSLDRLIKKEKLTEADKASALARIKGSTSYDDLKATDIVIEAATENYDLKVKILKQIDGIVGENVIIASNTSSISITKLAAVTSRADRFIGMHFFNPVPVMALVELIRGLQTSDTTHAAVEALSKQLGKYPITVKNSPGFVVNRILCPMINEAFCVLGEGLASPEEIDEGMKLGCNHPIGPLALADMIGLDTMLAVMEVLYTEFADPKYRPAMLMREMVAAGYLGRKTGRGVYVYSK

SEQ ID NO: 19 - protein, 261 aa, Clostridium sp.
MELNNVILEKEGKVAVVTINRPKALNALNSDTLKEMDYVIGEIENDSEVLAVILTGAGEKSFVAGADISEMKEMNTIEGRKFGILGNKVFRRLELLEKPVIAAVNGFALGGGCEIAMSCDIRIASSNARFGQPEVGLGITPGFGGTQRLSRLVGMGMAKQLIFTAQNIKADEALRIGLVNKVVEPSELMNTAKEIANKIVSNAPVAVKLSKQAINRGMQCDIDTALAFESEAFGECFSTEDQKDAMTAFIEKRKIEGFKNR

SEQ ID NO: 20 - protein, 397 aa, Treponema sp.
MIVKPMVRNNICLNAHPQGCKKGVEDQIEYTKKRITAEVKAGAKAPKNVLVLGCSNGYGLASRITAAFGYGAATIGVSFEKAGSETKYGTPGWYNNLAFDEAAKREGLYSVTIDGDAFSDEIKAQVIEEAKKKGIKFDLIVYSLASPVRTDPDTGIMHKSVLKPFGKTFTGKTVDPFTGELKEISAEPANDEEAAATVKVMGGEDWERWIKQLSKEGLLEEGCITLAYSYIGPEATQALYRKGTIGKAKEHLEATAHRLNKENPSIRAFVSVNKGLVTRASAVIPVIPLYLASLFKVMKEKGNHEGCIEQITRLYAERLYRKDGTIPVDEENRIRIDDWELEEDVQKAVSALMEKVTGENAESLTDLAGYRHDFLASNGFDVEGINYEAEVERFDRI

SEQ ID NO: 21 - protein, 394 aa, Ralstonia sp.
MTREVVVVSGVRTAIGTFGGSLKDVAPAELGALVVREALARAQVSGDDVGHVVFGNVIQTEPRDMYLGRVAAVNGGVTINAPALTVNRLCGSGLQAIVSAAQTILLGDTDVAIGGGAESMSRAPYLAPAARWGARMGDAGLVDMMLGALHDPFHRIHMGVTAENVAKEYDISRAQQDEAALESHRRASAAIKAGYFKDQIVPVVSKGRKGDVTFDTDEHVRHDATIDDMTKLRPVFVKENGTVTAGNASGLNDAAAAVVMMERAEAERRGLKPLARLVSYGHAGVDPKAMGIGPVPATKIALERAGLQVSDLDVIEANEAFAAQACAVTKALGLDPAKVNPNGSGISLGHPIGATGALITVKALHELNRVQGRYALVTMCIGGGQGIAAIFERI

SEQ ID NO: 22 - protein, 813 aa, Enterococcus sp.
MKEVVMIDAARTPIGKYRGSLSPFTAVELGTLVTKGLLDKTKLKKDKIDQVIFGNVLQAGNGQNVARQIALNSGLPVDVPAMTINEVCGSGMKAVILARQLIQLGEAELVIAGGTESMSQAPMLKPYQSETNEYGEPISSMVNDGLTDAFSNAHMGLTAEKVATQFSVSREEQDRYALSSQLKAAHAVEAGVFSEEIIPVKISDEDVLSEDEAVRGNSTLEKLGTLRTVFSEEGTVTAGNASPLNDGASVVILASKEYAENNNLPYLATIKEVAEVGIDPSIMGIAPIKAIQKLTDRSGMNLSTIDLFEINEAFAASSIVVSQELQLDEEKVNIYGGAIALGHPIGASGARILTTLAYGLLREQKRYGIASLCIGGGLGLAVLLEANMEQTHKDVQKKKFYQLTPSERRSQLIEKNVLTQETALIFQEQTLSEELSDHMIENQVSEVEIPMGIAQNFQINGKKKWIPMATEEPSVIAAASNGAKICGNICAETPQRLMRGQIVLSGKSEYQAVINAVNHRKEELILCANESYPSIVKRGGGVQDISTREFMGSFHAYLSIDFLVDVKDAMGANMINSILESVANKLREWFPEEEILFSILSNFATESLASACCEIPFERLGRNKEIGEQIAKKIQQAGEYAKLDPYRAATHNKGIMNGIEAVVAATGNDTRAVSASIHAYAARNGLYQGLTDWQIKGDKLVGKLTVPLAVATVGGASNILPKAKASLAMLDIDSAKELAQVIAAVGLAQNLAALRALVTEGIQKGHMGLQARSLAISIGAIGEEIEQVAKKLREAEKMNQQTAIQILEKIREK

SEQ ID NO: 23 - protein, 389 aa, Lactobacillus plantarum
MKIGIDKLHFATSHLYVDMAELATARQAEPDKYLIGIGQSKMAVIPPSQDVVTLAANAAAPMLTATDIAAIDLLVVGTESGIDNSKASAIYVAKLLGLSQRVRTIEMKEACYAATAGVQLAQDHVRVHPDKKALVIGSDVARYGLNTPGEPTQGGGAVAMLISADPKVLVLGTESSLLSEDVMDFWRPLYHTEALVDGKYSSNIYIDYFQDVFKNYLQTTQTSPDTLTALVFHLPYTKMGLKALRSVLPLVDAEKQAQWLAHFEHARQLNRQVGNLYTGSLYLSLLSQLLTDPQLQPGNRLGLFSYGSGAEGEFYTGVIQPDYQTGLDHGLPQRLARRRRVSVAEYEALFSHQLQWRADDQSVSYADDPHRFVLTGQKNEQRQYLDQQV

SEQ ID NO: 24 - protein, 491 aa, Saccharomyces cerevisiae
MKLSTKLCWCGIKGRLRPQKQQQLHNTNLQMTELKKQKTAEQKTRPQNVGIKGIQIYIPTQCVNQSELEKFDGVSQGKYTIGLGQTNMSFVNDREDIYSMSLTVLSKLIKSYNIDTNKIGRLEVGTETLIDKSKSVKSVLMQLFGENTDVEGIDTLNACYGGTNALFNSLNWIESNAWDGRDAIVVCGDIAIYDKGAARPTGGAGTVAMWIGPDAPIVFDSVRASYMEHAYDFYKPDFTSEYPYVDGHFSLTCYVKALDQVYKSYSKKAISKGLVSDPAGSDALNVLKYFDYNVFHVPTCKLVTKSYGRLLYNDFRANPQLFPEVDAELATRDYDESLTDKNIEKTFVNVAKPFHKERVAQSLIVPTNTGNMYTASVYAAFASLLNYVGSDDLQGKRVGLFSYGSGLAASLYSCKIVGDVQHIIKELDITNKLAKRITETPKDYEAAIELRENAHLKKNFKPQGSIEHLQSGVYYLTNIDDKFRRSYDVKK

SEQ ID NO: 25 - protein, 398 aa, Saccharomyces cerevisiae
MSQNVYIVSTARTPIGSFQGSLSSKTAVELGAVALKGALAKVPELDASKDFDEIIFGNVLSANLGQAPARQVALAAGLSNHIVASTVNKVCASAMKAIILGAQSIKCGNADVVVAGGCESMTNAPYYMPAARAGAKFGQTVLVDGVERDGLNDAYDGLAMGVHAEKCARDWDITREQQDNFAIESYQKSQKSQKEGKFDNEIVPVTIKGFRGKPDTQVTKDEEPARLHVEKLRSARTVFQKENGTVTAANASPINDGAAAVILVSEKVLKEKNLKPLAIIKGWGEAAHQPADFTWAPSLAVPKALKHAGIEDINSVDYFEFNEAFSVVGLVNTKILKLDPSKVNVYGGAVALGHPLGCSGARVVVTLLSILQQEGGKIGVAAICNGGGGASSIVIEKI

SEQ ID NO: 26 - protein, 247 aa, Bacteroides sp.
MSDDKKIGSYKFIAEPFHVDFNGRLTMGVLGNHLLNCAGFHASERGFGIATLNEDNYTWVLSRLAIDLEEMPYQYEEFTVQTWVENVYRLFTDRNFAIIDKDGKKIGYARSVWAMINLNTRKPADLLTLHGGSIVDYVCDEPCPIEKPSRIKVATDQPCAKLTAKYSDIDINGHVNSIRYIEHILDLFPIDLYKSKRIQRFEMAYVAESYYGDELSFFEEEVSENEYHVEIKKNGSEVVCRAKVKFV

SEQ ID NO: 27 - protein, 247 aa, Bacteroides thetaiotaomicron
MSEENKIGTYQFVAEPFHVDFNGRLTMGVLGNHLLNCAGFHASDRGFGIATLNEDNYTWVLSRLAIELDEMPYQYEKFSVQTWVENVYRLFTDRNFAVIDKDGKKIGYARSVWAMINLNTRKPADLLALHGGSIVDYICDEPCPIEKPSRIKVTSNQPVATLTAKYSDIDINGHVNSIRYIEHILDLFPIELYQTKRIRRFEMAYVAESYFGDELSFFCDEVSENEFHVEVKKNGSEVVCRSKVIFE

SEQ ID NO: 28 - protein, 238 aa, Bryantella formatexigen
MIYMAYQYRSRIRYSEIGEDKKLTLPGLVNYFQDCSTFQSEALGIGLDTLGARQRAWLLASWKIVIDRLPRLGEEVVTETWPYGFKGFQGNRNFRMLDQEGHTLAAAASVWIYLNVESGHPCRIDGDVLEAYELEEELPLGPFSRKIPVPEESTERDSFLVMRSHLDTNHHVNNGQYILMAEEYLPEGFKVKQIRVEYRKAAVLHDTIVPFVCTEPQRCTVSLCGSDEKPFAVVEFSE

SEQ ID NO: 29 - protein, 246 aa, Lactobacillus brevis
MAANEFSETHRVVYYEADDTGQLTLAMLINLFVLVSEDQNDALGLSTAFVQSHGVGWVVTQYHLHIDELPRTGAQVTIKTRATAYNRYFAYREYWLLDDAGQVLAYGEGIWVTMSYATRKITTIPAEVMAPYHSEEQTRLPRLPRPDHFDEAVNQTLKPYTVRYFDIDGNGHVNNAHYFDWMLDVLPATFLRAHHPTDVKIRFENEVQYGHQVTSELSQAAALTTQHMIKVGDLTAVKATIQWDNR

SEQ ID NO: 30 - protein, 261 aa, Lactobacillus plantarum
MATLGANASLYSEQHRITYYECDRTGRATLTTLIDIAVLASEDQSDALGLTTEMVQSHGVGWVVTQYAIDITRMPRQDEVVTIAVRGSAYNPYFAYREFWIRDADGQQLAYITSIWVMMSQTTRRIVKILPELVAPYQSEVVKRIPRLPRPISFEATDTTITKPYHVRFFDIDPNRHVNNAHYFDWLVDTLPATFLLQHDLVHVDVRYENEVKYGQTVTAHANILPSEVADQVTTSHLIEVDDEKCCEVTIQWRTLPEPIQ

SEQ ID NO: 31 - protein, 250 aa, Streptococcus dysgalactiae
MGLSYREDIKLPFELCDVKSDIKFPLLLDYCLTVSGRQSAQLGRSNDYLLEQYGLIWIVTDYEATIHRLPHFQETITIETKALSYNKFFCYRQFYIYDQEGGLLVDILAYFALLNPDTRKVATIPEDLVAPFETDFVKKLHRVPKMPLLEQSIDRDYYVRYFDIDMNGHVNNSKYLDWMYDVLGCEFLKTHQPLKMTLKYVKEVSPGGQITSSYHLDQLTSYHQITSDGQLNAQAMIEWRAIKQTESEID

SEQ ID NO: 32 - protein, 620 aa, Escherichia coli
MSFDIAKYPTLALVDSTQELRLLPKESLPKLCDELRRYLLDSVSRSSGHFASGLGTVELTVALHYVYNTPFDQLIWDVGHQAYPHKILTGRRDKIGTIRQKGGLHPFPWRGESEYDVLSVGHSSTSISAGIGIAVAAEKEGKNRRTVCVIGDGAITAGMAFEAMNHAGDIRPDMLVILNDNEMSISENVGALNNHLAQLLSGKLYSSLREGGKKVFSGVPPIKELLKRTEEHIKGMVVPGTLFEELGFNYIGPVDGHDVLGLITTLKNMRDLKGPQFLHIMTKKGRGYEPAEKDPITFHAVPKFDPSSGCLPKSSGGLPSYSKIFGDWLCETAAKDNKLMAITPAMREGSGMVEFSRKFPDRYFDVAIAEQHAVTFAAGLAIGGYKPIVAIYSTFLQRAYDQVLHDVAIQKLPVLFAIDRAGIVGADGQTHQGAFDLSYLRCIPEMVIMTPSDENECRQMLYTGYHYNDGPSAVRYPRGNAVGVELTPLEKLPIGKGIVKRRGEKLAILNFGTLMPEAAKVAESLNATLVDMRFVKPLDEALILEMAASHEALVTVEENAIMGGAGSGVNEVLMAHRKPVPVLNIGLPDFFIPQGTQEEMRAELGLDAAGMEAKIKAWLA

SEQ ID NO: 33 - protein, 398 aa, Escherichia coli
MKQLTILGSTGSIGCSTLDVVRHNPEHFRVVALVAGKNVTRMVEQCLEFSPRYAVMDDEASAKLLKTMLQQQGSRTEVLSGQQAACDMAALEDVDQVMAAIVGAAGLLPTLAAIRAGKTILLANKESLVTCGRLFMDAVKQSKAQLLPVDSEHNAIFQSLPQPIQHNLGYADLEQNGVVSILLTGSGGPFRETPLRDLATMTPDQACRHPNWSMGRKISVDSATMMNKGLEYIEARWLFNASASQMEVLIHPQSVIHSMVRYQDGSVLAQLGEPDMRTPIAHTMAWPNRVNSGVKPLDFCKLSALTFAAPDYDRYPCLKLAMEAFEQGQAATTALNAANEITVAAFLAQQIRFTDIAALNLSVLEKMDMREPQCVDDVLSVDANAREVARKEVMRLAS

SEQ ID NO: 34 - protein, 236 aa, Escherichia coli
MATTHLDVCAVVPAAGFGRRMQTECPKQYLSIGNQTILEHSVHALLAHPRVKRVVIAISPGDSRFAQLPLANHPRITVVDGGEERADSVLAGLKAAGDAQWVLVHDAARPCLHQDDLARLLALSETSRTGGILAAPVRDTMKRAEPGKNAIAHTVDRNGLWHALTPQFFPRELLHDCLTRALNEGATITDEASALEYCGFHPQLVEGRADNIKVTRPEDLALAEFYLTRTIHQENT

SEQ ID NO: 35 - protein, 283 aa, Escherichia coli
MRTQWPSPAKLNLFLYITGQRADGYHTLQTLFQFLDYGDTISIELRDDGDIRLLTPVEGVEHEDNLIVRAARLLMKTAADSGRLPTGSGANISIDKRLPMGGGLGGGSSNAATVLVALNHLWQCGLSMDELAEMGLTLGADVPVFVRGHAAFAEGVGEILTPVDPPEKWYLVAHPGVSIPTPVIFKDPELPRNTPKRSIETLLKCEFSNDCEVIARKRFREVDAVLSWLLEYAPSRLTGTGACVFAEFDTESEARQVLEQAPEWLNGFVAKGANLSPLHRAML

SEQ ID NO: 36 - protein, 159 aa, Escherichia coli
MRIGHGFDVHAFGGEGPIIIGGVRIPYEKGLLAHSDGDVVLHALTDALLGAAALGDIGKLFPDTDPAFKGADSRELLREAWRRIQAKGYALGNVDVTIIAQAPRMLPHIPQMRVFIAEDLGCHMDDVNVKATTTEKLGFTGRGEGIACEAVALLIKATK

SEQ ID NO: 37 - protein, 372 aa, Escherichia coli
MHNQAPIQRRKSTRIYVGNVPIGDGAPIAVQSMTNTRTTDVEATVNQIKALERVGADIVRVSVPTMDAAEAFKLIKQQVNVPLVADIHFDYRIALKVAEYGVDCLRINPGNIGNEERIRMVVDCARDKNIPIRIGVNAGSLEKDLQEKYGEPTPQALLESAMRHVDHLDRLNFDQFKVSVKASDVFLAVESYRLLAKQIDQPLHLGITEAGGARSGAVKSAIGLGLLLSEGIGDTLRVSLAADPVEEIKVGFDILKSLRIRSRGINFIACPTCSRQEFDVIGTVNALEQRLEDIITPMDVSIIGCVVNGPGEALVSTLGVTGGNKKSGLYEDGVRKDRLDNNDMIDQLEARIRAKASQLDEARRIDVQQVEK

SEQ ID NO: 38 - protein, 316 aa, Escherichia coli
MQILLANPRGFCAGVDRAISIVENALAIYGAPIYVRHEVVHNRYVVDSLRERGAIFIEQISEVPDGAILIFSAHGVSQAVRNEAKSRDLTVFDATCPLVTKVHMEVARASRRGEESILIGHAGHPEVEGTMGQYSNPEGGMYLVESPDDVWKLTVKNEEKLSFMTQTTLSVDDTSDVIDALRKRFPKIVGPRKDDICYATTNRQEAVRALAEQAEVVLVVGSKNSSNSNRLAELAQRMGKRAFLIDDATDIQEEWVKEAKCVGVTAGASAPDILVQNVVARLQQLGGGEAIPLEGREENIVFEVPKELRVDIREVD

SEQ ID NO: 39 - protein, 182 aa, Escherichia coli
MQTEHVILLNAQGVPTGTLEKYAAHTADTRLHLAFSSWLFNAKGQLLVTRRALSKKAWPGVWTNSVCGHPQLGESNEDAVIRRCRYELGVEITPPESIYPDFRYRATDPSGIVENEVCPVFAARTTSALQINDDEVMDYQWCDLADVLHGIDATPWAFSPWMVMQATNREARKRLSAFTQLK

SEQ ID NO: 40 - protein, 299 aa, Escherichia coli
MDFPQQLEACVKQANQALSRFIAPLPFQNTPVVETMQYGALLGGKRLRPFLVYATGHMFGVSTNTLDAPAAAVECIHAYSLIHDDLPAMDDDDLRRGLPTCHVKFGEANAILAGDALQTLAFSILSDADMPEVSDRDRISMISELASASGIAGMCGGQALDLDAEGKHVPLDALERIHRHKTGALIRAAVRLGALSAGDKGRRALPVLDKYAESIGLAFQVQDDILDVVGDTATLGKRQGADQQLGKSTYPALLGLEQARKKARDLIDDARQSLKQLAEQSLDTSALEALADYIIQRNK

SEQ ID NO: 41 - DNA, 1083 bp, Saccharomyces cerevisiae
atgaagctactaaccttcccaggtcaagggacctccatctccatttcgatattaaaagcgataataagaaacaaatcaagagaattccaaacaatactgagtcagaacggcaaggaatcaaatgatctattgcagtacatcttccagaacccttccagccccggaagcattgcagtctgctccaaccttttctatcaattgtaccagatactctcgaatccttctgatcctcaagatcaagcaccaaaaaatatgactaagatcgattcccccgacaagaaagacaatgaacaatgttaccttttgggtcactcgctaggcgagttaacatgtctgagtgttaattcactgttttcgttaaaggatctttttgatattgctaattttagaaataagttaatggtaacatctactgaaaagtacttagtagcccacaatatcaacagatccaacaaatttgaaatgtgggcactctcttctccgagggccacagatttaccgcaagaagtgcaaaaactactaaattcccctaatttattatcatcttcacaaaataccatttctgtagcaaatgcaaattcagtaaagcaatgtgtagtcaccggtctggttgatgatttagagtccttaagaacagaattgaacttaaggttcccgcgtttaagaattacagaattaactaacccatacaacatccccttccataatagcactgtgttgaggcccgttcaggaaccactctatgactacatttgggatatattaaagaaaaacggaactcacacgttgatggagttgaaccatccaataatagctaacttagatggtaatatatcttactatattcatcatgccctagatagattcgttaagtgttcaagcaggactgtgcaattcaccatgtgttatgataccataaactctggaaccccagtggaaattgataagagtatttgctttggcccgggcaatgtgatttataaccttattcggagaaattgtccccaagtggacactatagaatacacctctttagcaactatagacgcttatcacaaggcggcagaggagaacaaagattga

SEQ ID NO: 42 - protein, 360 aa, Saccharomyces cerevisiae
MKLLTFPGQGTSISISILKAIIRNKSREFQTILSQNGKESNDLLQYIFQNPSSPGSIAVCSNLFYQLYQILSNPSDPQDQAPKNMTKIDSPDKKDNEQCYLLGHSLGELTCLSVNSLFSLKDLFDIANFRNKLMVTSTEKYLVAHNINRSNKFEMWALSSPRATDLPQEVQKLLNSPNLLSSSQNTISVANANSVKQCVVTGLVDDLESLRTELNLRFPRLRITELTNPYNIPFHNSTVLRPVQEPLYDYIWDILKKNGTHTLMELNHPIIANLDGNISYYIHHALDRFVKCSSRTVQFTMCYDTINSGTPVEIDKSICFGPGNVIYNLIRRNCPQVDTIEYTSLATIDAYHKAAEENKD

SEQ ID NO: 43 - DNA, 1191 bp, Artificial Sequence
  Artificial beta-ketothiolase (BktB) nucleotide sequence
atgactagagaagttgtcgtcgtttccggtgtccgtaccgctatcggtactttcggtggttccttaaaggatgttgctcctgctgaattgggtgctttagttgttagagaagctttggccagagcccaagtctccggtgacgacgttggtcacgtcgttttcggtaacgtcatccaaactgaaccacgtgacatgtacttgggtagagtcgccgctgttaacggtggtgtcaccatcaacgctcctgccttaactgttaacagattatgtggttccggtttacaagctattgtctctgccgcccaaactatcttgttgggtgatactgacgttgctattggtggtggtgctgaatctatgtctagagctccatacttggctccagctgcccgttggggtgctagaatgggtgacgccggtttggtcgatatgatgttgggtgccttgcatgatcctttccacagaatccacatgggtgttaccgctgaaaacgttgctaaggaatacgatatctctagagctcaacaagatgaagccgctttagaatctcacagacgtgcctccgccgctattaaggctggttacttcaaggaccaaattgttccagttgtctctaagggtcgtaaaggtgatgttacctttgatactgacgaacacgttagacacgacgccactattgacgatatgactaaattaagaccagtctttgttaaggagaatggtaccgttactgctggtaacgcttctggtttgaacgatgccgccgctgccgttgttatgatggaaagagctgaagccgaaagacgtggtttaaagccattggccagattagtctcctacggtcacgctggtgtcgacccaaaggctatgggtatcggtccagttcctgctactaagattgctttagaaagagctggtttgcaagtttctgacttggacgtcatcgaagccaacgaagccttcgctgctcaagcttgtgctgtcaccaaggctttgggtttggatccagctaaagttaaccctaatggttctggtatttccttgggtcacccaatcggtgctaccggtgctttaatcactgttaaagccttacacgaattgaacagagttcaaggtagatacgctttggtcactatgtgcatcggtggtggtcaaggtatcgctgctatcttcgaaagaatcggatcctaa

SEQ ID NO: 44 - protein, 396 aa, Artificial Sequence
  Engineered beta-ketothiolase (BktB)
MTREVVVVSGVRTAIGTFGGSLKDVAPAELGALVVREALARAQVSGDDVGHVVFGNVIQTEPRDMYLGRVAAVNGGVTINAPALTVNRLCGSGLQAIVSAAQTILLGDTDVAIGGGAESMSRAPYLAPAARWGARMGDAGLVDMMLGALHDPFHRIHMGVTAENVAKEYDISRAQQDEAALESHRRASAAIKAGYFKDQIVPVVSKGRKGDVTFDTDEHVRHDATIDDMTKLRPVFVKENGTVTAGNASGLNDAAAAVVMMERAEAERRGLKPLARLVSYGHAGVDPKAMGIGPVPATKIALERAGLQVSDLDVIEANEAFAAQACAVTKALGLDPAKVNPNGSGISLGHPIGATGALITVKALHELNRVQGRYALVTMCIGGGQGIAAIFERIGS

SEQ ID NO: 45 - DNA, 858 bp, Artificial Sequence
  Artificial PaaH1: 3-hydroxyacyl-CoA dehydrogenase nucleotide sequence
atgtccatcagaactgtcggtattgttggtgctggtactatgggtaacggtattgctcaagcctgtgctgtcgtcggtttgaacgtcgtcatggtcgacatttctgacgctgctgttcaaaagggtgttgctactgtcgcttcctctttggacagattaattaagaaggaaaagttgaccgaagccgacaaggcctctgccttggccagaattaagggttccacttcttatgacgacttgaaagctaccgacattgttatcgaagctgctactgaaaactacgatttgaaagttaagatcttgaagcaaattgatggtatcgtcggtgagaacgtcattattgcttctaacacttcctccatttctatcactaaattagccgccgtcacctctagagccgacagatttatcggtatgcacttctttaatccagttccagtcatggctttggtcgaattaattagaggtttgcaaacctccgacaccacccacgccgccgttgaagctttgtctaagcaattgggtaagtacccaatcaccgttaaaaattccccaggtttcgttgtcaaccgtattttgtgcccaatgatcaatgaagctttctgtgtcttgggtgagggtttggcctccccagaagaaatcgatgaaggtatgaagttaggttgtaaccaccctattggtcctttagccttggccgacatgatcggtttagacactatgttggccgttatggaagtcttgtacactgaattcgctgacccaaagtacagaccagctatgttaatgagagaaatggttgctgccggttatttgggtagaaagactggtcgtggtgtttatgtctactctaaagggatc

SEQ ID NO: 46 - protein, 286 aa, Artificial Sequence
  Engineered PaaH1: 3-hydroxyacyl-CoA dehydrogenase
MSIRTVGIVGAGTMGNGIAQACAVVGLNVVMVDISDAAVQKGVATVASSLDRLIKKEKLTEADKASALARIKGSTSYDDLKATDIVIEAATENYDLKVKILKQIDGIVGENVIIASNTSSISITKLAAVTSRADRFIGMHFFNPVPVMALVELIRGLQTSDTTHAAVEALSKQLGKYPITVKNSPGFVVNRILCPMINEAFCVLGEGLASPEEIDEGMKLGCNHPIGPLALADMIGLDTMLAVMEVLYTEFADPKYRPAMLMREMVAAGYLGRKTGRGVYVYSKGI

SEQ ID NO: 47 - DNA, 792 bp, Artificial Sequence
  Artificial crotonase (Crt) nucleotide sequence
atggaattgaacaacgttattttggaaaaggaaggtaaggtcgctgtcgttactatcaacagaccaaaggctttaaacgctttgaactctgacaccttgaaagaaatggattatgttatcggtgaaatcgaaaatgactctgaagttttggccgttatcttgactggtgctggtgaaaaatctttcgttgctggtgctgacatttctgaaatgaaggagatgaataccattgaaggtagaaagttcggtatcttgggtaacaaggtttttagaagattggaattgttggaaaaaccagtcatcgctgctgttaacggtttcgctttaggtggtggttgtgaaatcgctatgtcctgtgacattcgtatcgcctcctccaatgctagattcggtcaaccagaagttggtttaggtattactccaggtttcggtggtacccaaagattgtctagattggtcggtatgggtatggctaagcaattaattttcactgctcaaaacattaaggctgatgaagccttacgtattggtttggtcaacaaggtcgttgaaccatctgaattgatgaataccgctaaggaaattgctaacaaaattgtttctaatgccccagttgctgtcaagttgtccaagcaagctattaacagaggtatgcaatgtgatattgacactgctttggctttcgaatccgaagcttttggtgaatgtttttctaccgaagatcaaaaggatgctatgaccgctttcatcgagaagagaaagatcgaaggtttcaaaaacagaggatcctaa

SEQ ID NO: 48 - protein, 263 aa, Artificial Sequence
  Engineered crotonase (Crt)
MELNNVILEKEGKVAVVTINRPKALNALNSDTLKEMDYVIGEIENDSEVLAVILTGAGEKSFVAGADISEMKEMNTIEGRKFGILGNKVFRRLELLEKPVIAAVNGFALGGGCEIAMSCDIRIASSNARFGQPEVGLGITPGFGGTQRLSRLVGMGMAKQLIFTAQNIKADEALRIGLVNKVVEPSELMNTAKEIANKIVSNAPVAVKLSKQAINRGMQCDIDTALAFESEAFGECFSTEDQKDAMTAFIEKRKIEGFKNRGS

SEQ ID NO: 49 - DNA, 1200 bp, Artificial Sequence
  Artificial Ter: trans-2-enoyl-CoA reductase nucleotide sequence
atgattgtcaaaccaatggttcgtaacaacatttgtttaaatgcccacccacaaggttgtaagaagggtgttgaagatcaaatcgaatacactaaaaagagaattaccgctgaagttaaagctggtgctaaggccccaaagaacgttttggttttgggttgttccaacggttacggtttggcctccagaattactgctgcttttggttacggtgccgctaccatcggtgtctctttcgaaaaggccggttccgaaactaagtacggtactccaggttggtacaataacttggctttcgatgaagctgctaagagagaaggtttgtattccgttactattgacggtgatgccttttctgacgaaatcaaagctcaagtcatcgaagaagccaaaaagaaaggtatcaagttcgatttgattgtctactctttagcctctcctgttagaactgatccagatactggtattatgcacaaatccgttttgaagccattcggtaagaccttcactggtaaaactgtcgatcctttcactggtgaattaaaggaaatctctgctgaacctgccaacgacgaagaagctgctgccactgttaaggttatgggtggtgaagactgggaaagatggatcaagcaattatctaaggaaggtttgttggaagaaggttgtatcaccttggcttactcttacatcggtccagaagctacccaagctttgtacagaaagggtaccattggtaaggctaaagaacacttggaggctactgctcatagattgaacaaggaaaatccatccatcagagcctttgtttccgtcaataaaggtttggtcactagagcctctgccgtcattccagttatccctttatacttggcttctttgtttaaagtcatgaaggaaaagggtaaccatgaaggttgtatcgaacaaatcactcgtttgtacgctgaacgtttatacagaaaggacggtaccatccctgtcgatgaagaaaacagaatcagaatcgacgattgggaattggaagaagatgttcaaaaagccgtttccgccttgatggaaaaggtcaccggtgaaaatgccgaatccttgactgacttagctggttacagacatgactttttagcttctaatggtttcgatgttgaaggtattaactatgaggctgaagtcgaaagatttgacagaatcggatcctaa

SEQ ID NO: 50 - protein, 399 aa, Artificial Sequence
  Engineered Ter: trans-2-enoyl-CoA reductase
MIVKPMVRNNICLNAHPQGCKKGVEDQIEYTKKRITAEVKAGAKAPKNVLVLGCSNGYGLASRITAAFGYGAATIGVSFEKAGSETKYGTPGWYNNLAFDEAAKREGLYSVTIDGDAFSDEIKAQVIEEAKKKGIKFDLIVYSLASPVRTDPDTGIMHKSVLKPFGKTFTGKTVDPFTGELKEISAEPANDEEAAATVKVMGGEDWERWIKQLSKEGLLEEGCITLAYSYIGPEATQALYRKGTIGKAKEHLEATAHRLNKENPSIRAFVSVNKGLVTRASAVIPVIPLYLASLFKVMKEKGNHEGCIEQITRLYAERLYRKDGTIPVDEENRIRIDDWELEEDVQKAVSALMEKVTGENAESLTDLAGYRHDFLASNGFDVEGINYEAEVERFDRIGS

SEQ ID NO: 51 - DNA, 812 bp, Artificial Sequence
  Truncated 3-hydroxy-3-methyl-glutaryl-CoA reductase (tHMG1)
atggcgcgtgaccaattggtgaaaactgaagtcaccaagaagtcttttactgctcctgtacaaaaggcttctacaccagttttaaccaataaaacagtcatttctggatcgaaagtcaaaagtttatcatctgcgcaatcgagctcatcaggaccttcatcatctagtgaggaagatgattcccgcgatattgaaagcttggataagaaaatacgtcctttagaagaattagaagcattattaagtagtggaaatacaaaacaattgaagaacaaagaggtcgctgccttggttattcacggtaagttacctttgtacgctttggagaaaaaattaggtgatactacgagagcggttgcggtacgtaggaaggctctttcaattttggcagaagctcctgtattagcatctgatcgtttaccatataaaaattatgactacgaccgcgtatttggcgcttgttgtgaaaatgttataggttacatgcctttgcccgttggtgttataggccccttggttatcgatggtacatcttatcatataccaatggcaactacagagggttgtttggtagcttctgccatgcgtggctgtaaggcaatcaatgctggcggtggtgcaacaactgttttaactaaggatggtatgacaagaggcccagtagtccgtttcccaactttgaaaagatctggtgcctgtaagatatggttagactcagaagagggacaaaacgcaattaaaaaagcttttaactctacatcaagatttgcacgtctgcaacatattcaaacttgtctagcaggagatttgtt

SEQ ID NO: 52 - protein, 270 aa, Artificial Sequence
  Truncated 3-hydroxy-3-methyl-glutaryl-CoA reductase (tHMG1)
MARDQLVKTEVTKKSFTAPVQKASTPVLTNKTVISGSKVKSLSSAQSSSSGPSSSSEEDDSRDIESLDKKIRPLEELEALLSSGNTKQLKNKEVAALVIHGKLPLYALEKKLGDTTRAVAVRRKALSILAEAPVLASDRLPYKNYDYDRVFGACCENVIGYMPLPVGVIGPLVIDGTSYHIPMATTEGCLVASAMRGCKAINAGGGATTVLTKDGMTRGPVVRFPTLKRSGACKIWLDSEEGQNAIKKAFNSTSRFARLQHIQTCLAGDL

SEQ ID NO: 53 - DNA, 2412 bp, Enterococcus sp.
atgaagactgtcgttatcatagatgccttgagaacaccaatcggtaaatacaaaggttcattatcccaagtttccgccgttgacttaggtactcatgttactacacaattgttgaagagacactccacaatcagtgaagaaatcgatcaagtcatattcggtaacgtattgcaagctggtaatggtcaaaacccagccagacaaatagctatcaattctggtttatcacatgaaattcctgctatgacagtaaacgaagtttgtggttcaggcatgaaagcagtcattttggccaagcaattgatacaattaggtgaagcagaagttttaatcgccggtggtatagaaaacatgagtcaagctccaaaattgcaaagattcaattacgaaactgaatcttacgatgcacctttctcttcgatgatgtatgatggtttgactgacgctttttctggtcaagcaatgggtttaacagctgaaaatgtcgcagaaaagtaccatgtaaccagagaagaacaagatcaattttccgttcacagtcaattaaaagctgcacaagcacaagccgaaggtattttcgccgacgaaatagctccattggaagtttctggtacattagtcgaaaaggatgaaggtattagacctaactccagtgttgaaaaattgggtactttgaagacagtattcaaggaagacggtacagttaccgctggtaatgcctctaccattaacgatggtgctagtgcattgattatagcttctcaagaatatgccgaagctcatggtttgccatacttagctatcattagagatagtgtagaagttggtattgacccagcatacatgggtatctctcctataaaagcaatccaaaagttgttagccagaaaccaattgaccactgaagaaattgatttgtacgaaattaacgaagcatttgccgctacatcaatcgttgtccaaagagaattggcattgccagaagaaaaggttaacatctatggtggtggtatctccttgggtcacgctataggtgcaaccggtgccagattgttgacttccttaagttaccaattgaaccaaaaggaaaagaaatacggtgttgcttctttatgcattggtggtggtttgggtttagcaatgttgttagaaagaccacaacaaaagaaaaattctagattctaccaaatgtcccctgaagaaagattggcctcattgttaaatgaaggtcaaatttccgcagatactaagaaagaatttgaaaacaccgctttatcttcacaaatcgcaaaccatatgatcgaaaaccaaatctctgaaacagaagttccaatgggtgtcggtttgcacttaactgtcgatgaaacagactatttggtaccaatggctaccgaagaacctagtgttatcgcagccttatctaatggtgctaagatagcacaaggttttaagactgttaaccaacaaagattgatgagaggtcaaatcgtattctacgatgttgctgacccagaatcattaatcgataagttgcaagtaagagaagccgaagtttttcaacaagctgaattgtcttacccttcaatagttaagagaggtggtggtttgagagatttgcaatacagaacttttgacgaatccttcgtcagtgtagatttcttagttgatgtcaaggacgccatgggtgctaatattgttaacgcaatgttggaaggtgtcgccgaattgtttagagaatggttcgctgaacaaaagattttgttttctatcttgtcaaactacgctacagaatctgtagttaccatgaaaactgcaattccagtttccagattgagtaagggttctaacggtagagaaatcgctgaaaagattgttttggcatcaagatatgcctccttagacccttacagagctgttactcataataagggtataatgaacggtatcgaagctgtcgtattagcaaccggtaatgatactagagcagtatctgcctcatgtcacgcattcgccgttaaggaaggtagataccaaggtttgacatcatggaccttggatggtgaacaattaattggtgaaatatccgttccattggctttagcaactgttggtggtgctacaaaagtcttgcctaagagtcaagctgcagccgatttgttagccgtcactgacgctaaggaattgtctagagttgtcgctgcagtaggtttagctcaaaatttggccgctttaagagcattggtttcagaaggtattcaaaaaggtcatatggctttgcaagcaagatccttagccatgacagttggtgctaccggtaaagaagtcgaagccgtagctcaacaattaaaaagacaaaagacaatgaaccaagacagagcaatggctatattaaacgatttgagaaagcaataa

SEQ ID NO: 54 - protein, 803 aa, Enterococcus sp.
MKTVVIIDALRTPIGKYKGSLSQVSAVDLGTHVTTQLLKRHSTISEEIDQVIFGNVLQAGNGQNPARQIAINSGLSHEIPAMTVNEVCGSGMKAVILAKQLIQLGEAEVLIAGGIENMSQAPKLQRFNYETESYDAPFSSMMYDGLTDAFSGQAMGLTAENVAEKYHVTREEQDQFSVHSQLKAAQAQAEGIFADEIAPLEVSGTLVEKDEGIRPNSSVEKLGTLKTVFKEDGTVTAGNASTINDGASALIIASQEYAEAHGLPYLAIIRDSVEVGIDPAYMGISPIKAIQKLLARNQLTTEEIDLYEINEAFAATSIVVQRELALPEEKVNIYGGGISLGHAIGATGARLLTSLSYQLNQKEKKYGVASLCIGGGLGLAMLLERPQQKKNSRFYQMSPEERLASLLNEGQISADTKKEFENTALSSQIANHMIENQISETEVPMGVGLHLTVDETDYLVPMATEEPSVIAALSNGAKIAQGFKTVNQQRLMRGQIVFYDVADPESLIDKLQVREAEVFQQAELSYPSIVKRGGGLRDLQYRTFDESFVSVDFLVDVKDAMGANIVNAMLEGVAELFREWFAEQKILFSILSNYATESVVTMKTAIPVSRLSKGSNGREIAEKIVLASRYASLDPYRAVTHNKGIMNGIEAVVLATGNDTRAVSASCHAFAVKEGRYQGLTSWTLDGEQLIGEISVPLALATVGGATKVLPKSQAAADLLAVTDAKELSRVVAAVGLAQNLAALRALVSEGIQKGHMALQARSLAMTVGATGKEVEAVAQQLKRQKTMNQDRAMAILNDLRKQ

SEQ ID NO: 55 - DNA, 1152 bp, Enterococcus sp.
atgacaattgggattgataaaattagtttttttgtgcccccttattatattgatatgacggcactggctgaagccagaaatgtagaccctggaaaatttcatattggtattgggcaagaccaaatggcggtgaacccaatcagccaagatattgtgacatttgcagccaatgccgcagaagcgatcttgaccaaagaagataaagaggccattgatatggtgattgtcgggactgagtccagtatcgatgagtcaaaagcggccgcagttgtcttacatcgtttaatggggattcaacctttcgctcgctctttcgaaatcaaggaagcttgttacggagcaacagcaggcttacagttagctaagaatcacgtagccttacatccagataaaaaagtcttggtcgtagcggcagatattgcaaaatatggcttaaattctggcggtgagcctacacaaggagctggggcggttgcaatgttagttgctagtgaaccgcgcattttggctttaaaagaggataatgtgatgctgacgcaagatatctatgacttttggcgtccaacaggccacccgtatcctatggtcgatggtcctttgtcaaacgaaacctacatccaatcttttgcccaagtctgggatgaacataaaaaacgaaccggtcttgattttgcagattatgatgctttagcgttccatattccttacacaaaaatgggcaaaaaagccttattagcaaaaatctccgaccaaactgaagcagaacaggaacgaattttagcccgttatgaagaaagtatcgtctatagtcgtcgcgtaggaaacttgtatacgggttcactttatctgggactcatttcccttttagaaaatgcaacgactttaaccgcaggcaatcaaattggtttattcagttatggttctggtgctgtcgctgaatttttcactggtgaattagtagctggttatcaaaatcatttacaaaaagaaactcatttagcactgctggataatcggacagaactttctatcgctgaatatgaagccatgtttgcagaaactttagacacagacattgatcaaacgttagaagatgaattaaaatatagtatttctgctattaataataccgttcgttcttatcgaaactaa

SEQ ID NO: 56 - protein, 383 aa, Enterococcus sp.
MTIGIDKISFFVPPYYIDMTALAEARNVDPGKFHIGIGQDQMAVNPISQDIVTFAANAAEAILTKEDKEAIDMVIVGTESSIDESKAAAVVLHRLMGIQPFARSFEIKEACYGATAGLQLAKNHVALHPDKKVLVVAADIAKYGLNSGGEPTQGAGAVAMLVASEPRILALKEDNVMLTQDIYDFWRPTGHPYPMVDGPLSNETYIQSFAQVWDEHKKRTGLDFADYDALAFHIPYTKMGKKALLAKISDQTEAEQERILARYEESIVYSRRVGNLYTGSLYLGLISLLENATTLTAGNQIGLFSYGSGAVAEFFTGELVAGYQNHLQKETHLALLDNRTELSIAEYEAMFAETLDTDIDQTLEDELKYSISAINNTVRSYRN

SEQ ID NO: 57 - DNA, 867 bp, Saccharomyces sp.
atgactgccgacaacaatagtatgccccatggtgcagtatctagttacgccaaattagtgcaaaaccaaacacctgaagacattttggaagagtttcctgaaattattccattacaacaaagacctaatacccgatctagtgagacgtcaaatgacgaaagcggagaaacatgtttttctggtcatgatgaggagcaaattaagttaatgaatgaaaattgtattgttttggattgggacgataatgctattggtgccggtaccaagaaagtttgtcatttaatggaaaatattgaaaagggtttactacatcgtgcattctccgtctttattttcaatgaacaaggtgaattacttttacaacaaagagccactgaaaaaataactttccctgatctttggactaacacatgctgctctcatccactatgtattgatgacgaattaggtttgaagggtaagctagacgataagattaagggcgctattactgcggcggtgagaaaactagatcatgaattaggtattccagaagatgaaactaagacaaggggtaagtttcactttttaaacagaatccattacatggcaccaagcaatgaaccatggggtgaacatgaaattgattacatcctattttataagatcaacgctaaagaaaacttgactgtcaacccaaacgtcaatgaagttagagacttcaaatgggtttcaccaaatgatttgaaaactatgtttgctgacccaagttacaagtttacgccttggtttaagattatttgcgagaattacttattcaactggtgggagcaattagatgacctttctgaagtggaaaatgacaggcaaattcatagaatgctataa

SEQ ID NO: 58 - protein, 288 aa, Saccharomyces sp.
MTADNNSMPHGAVSSYAKLVQNQTPEDILEEFPEIIPLQQRPNTRSSETSNDESGETCFSGHDEEQIKLMNENCIVLDWDDNAIGAGTKKVCHLMENIEKGLLHRAFSVFIFNEQGELLLQQRATEKITFPDLWTNTCCSHPLCIDDELGLKGKLDDKIKGAITAAVRKLDHELGIPEDETKTRGKFHFLNRIHYMAPSNEPWGEHEIDYILFYKINAKENLTVNPNVNEVRDFKWVSPNDLKTMFADPSYKFTPWFKIICENYLFNWWEQLDDLSEVENDRQIHRML

SEQ ID NO: 59 - DNA, 1059 bp, Artificial Sequence
  Mutant farnesyl pyrophosphate synthase (Erg20mut, F96W, N127W)
atggcttcagaaaaagaaattaggagagagagattcttgaacgttttccctaaattagtagaggaattgaacgcatcgcttttggcttacggtatgcctaaggaagcatgtgactggtatgcccactcattgaactacaacactccaggcggtaagctaaatagaggtttgtccgttgtggacacgtatgctattctctccaacaagaccgttgaacaattggggcaagaagaatacgaaaaggttgccattctaggttggtgcattgagttgttgcaggcttactggttggtcgccgatgatatgatggacaagtccattaccagaagaggccaaccatgttggtacaaggttcctgaagttggggaaattgccatctgggacgcattcatgttagaggctgctatctacaagcttttgaaatctcacttcagaaacgaaaaatactacatagatatcaccgaattgttccatgaggtcaccttccaaaccgaattgggccaattgatggacttaatcactgcacctgaagacaaagtcgacttgagtaagttctccctaaagaagcactccttcatagttactttcaagactgcttactattctttctacttgcctgtcgcattggccatgtacgttgccggtatcacggatgaaaaggatttgaaacaagccagagatgtcttgattccattgggtgaatacttccaaattcaagatgactacttagactgcttcggtaccccagaacagatcggtaagatcggtacagatatccaagataacaaatgttcttgggtaatcaacaaggcattggaacttgcttccgcagaacaaagaaagactttagacgaaaattacggtaagaaggactcagtcgcagaagccaaatgcaaaaagattttcaatgacttgaaaattgaacagctataccacgaatatgaagagtctattgccaaggatttgaaggccaaaatttctcaggtcgatgagtctcgtggcttcaaagctgatgtcttaactgcgttcttgaacaaagtttacaagagaagcaaatag

SEQ ID NO: 60 - protein, 352 aa, Artificial Sequence
  Mutant farnesyl pyrophosphate synthase (Erg20mut, F96W, N127W)
MASEKEIRRERFLNVFPKLVEELNASLLAYGMPKEACDWYAHSLNYNTPGGKLNRGLSVVDTYAILSNKTVEQLGQEEYEKVAILGWCIELLQAYWLVADDMMDKSITRRGQPCWYKVPEVGEIAIWDAFMLEAAIYKLLKSHFRNEKYYIDITELFHEVTFQTELGQLMDLITAPEDKVDLSKFSLKKHSFIVTFKTAYYSFYLPVALAMYVAGITDEKDLKQARDVLIPLGEYFQIQDDYLDCFGTPEQIGKIGTDIQDNKCSWVINKALELASAEQRKTLDENYGKKDSVAEAKCKKIFNDLKIEQLYHEYEESIAKDLKAKISQVDESRGFKADVLTAFLNKVYKRSK

SEQ ID NO: 61 - DNA, 1356 bp, Saccharomyces sp.
atgtcagagttgagagccttcagtgccccagggaaagcgttactagctggtggatatttagttttagatacaaaatatgaagcatttgtagtcggattatcggcaagaatgcatgctgtagcccatccttacggttcattgcaagggtctgataagtttgaagtgcgtgtgaaaagtaaacaatttaaagatggggagtggctgtaccatataagtcctaaaagtggcttcattcctgtttcgataggcggatctaagaaccctttcattgaaaaagttatcgctaacgtatttagctactttaaacctaacatggacgactactgcaatagaaacttgttcgttattgatattttctctgatgatgcctaccattctcaggaggatagcgttaccgaacatcgtggcaacagaagattgagttttcattcgcacagaattgaagaagttcccaaaacagggctgggctcctcggcaggtttagtcacagttttaactacagctttggcctccttttttgtatcggacctggaaaataatgtagacaaatatagagaagttattcataatttagcacaagttgctcattgtcaagctcagggtaaaattggaagcgggtttgatgtagcggcggcagcatatggatctatcagatatagaagattcccacccgcattaatctctaatttgccagatattggaagtgctacttacggcagtaaactggcgcatttggttgatgaagaagactggaatattacgattaaaagtaaccatttaccttcgggattaactttatggatgggcgatattaagaatggttcagaaacagtaaaactggtccagaaggtaaaaaattggtatgattcgcatatgccagaaagcttgaaaatatatacagaactcgatcatgcaaattctagatttatggatggactatctaaactagatcgcttacacgagactcatgacgattacagcgatcagatatttgagtctcttgagaggaatgactgtacctgtcaaaagtatcctgaaatcacagaagttagagatgcagttgccacaattagacgttcctttagaaaaataactaaagaatctggtgccgatatcgaacctcccgtacaaactagcttattggatgattgccagaccttaaaaggagttcttacttgcttaatacctggtgctggtggttatgacgccattgcagtgattactaagcaagatgttgatcttagggctcaaaccgctaatgacaaaagattttctaaggttcaatggctggatgtaactcaggctgactggggtgttaggaaagaaaaagatccggaaacttatcttgataaataa

SEQ ID NO: 62 - protein, 451 aa, Saccharomyces sp.
MSELRAFSAPGKALLAGGYLVLDTKYEAFVVGLSARMHAVAHPYGSLQGSDKFEVRVKSKQFKDGEWLYHISPKSGFIPVSIGGSKNPFIEKVIANVFSYFKPNMDDYCNRNLFVIDIFSDDAYHSQEDSVTEHRGNRRLSFHSHRIEEVPKTGLGSSAGLVTVLTTALASFFVSDLENNVDKYREVIHNLAQVAHCQAQGKIGSGFDVAAAAYGSIRYRRFPPALISNLPDIGSATYGSKLAHLVDEEDWNITIKSNHLPSGLTLWMGDIKNGSETVKLVQKVKNWYDSHMPESLKIYTELDHANSRFMDGLSKLDRLHETHDDYSDQIFESLERNDCTCQKYPEITEVRDAVATIRRSFRKITKESGADIEPPVQTSLLDDCQTLKGVLTCLIPGAGGYDAIAVITKQDVDLRAQTANDKRFSKVQWLDVTQADWGVRKEKDPETYLDK

SEQ ID NO: 63 - DNA, 1332 bp, Saccharomyces sp.
atgtcattaccgttcttaacttctgcaccgggaaaggttattatttttggtgaacactctgctgtgtacaacaagcctgccgtcgctgctagtgtgtctgcgttgagaacctacctgctaataagcgagtcatctgcaccagatactattgaattggacttcccggacattagctttaatcataagtggtccatcaatgatttcaatgccatcaccgaggatcaagtaaactcccaaaaattggccaaggctcaacaagccaccgatggcttgtctcaggaactcgttagtcttttggatccgttgttagctcaactatccgaatccttccactaccatgcagcgttttgtttcctgtatatgtttgtttgcctatgcccccatgccaagaatattaagttttctttaaagtctactttacccatcggtgctgggttgggctcaagcgcctctatttctgtatcactggccttagctatggcctacttgggggggttaataggatctaatgacttggaaaagctgtcagaaaacgataagcatatagtgaatcaatgggccttcataggtgaaaagtgtattcacggtaccccttcaggaatagataacgctgtggccacttatggtaatgccctgctatttgaaaaagactcacataatggaacaataaacacaaacaattttaagttcttagatgatttcccagccattccaatgatcctaacctatactagaattccaaggtctacaaaagatcttgttgctcgcgttcgtgtgttggtcaccgagaaatttcctgaagttatgaagccaattctagatgccatgggtgaatgtgccctacaaggcttagagatcatgactaagttaagtaaatgtaaaggcaccgatgacgaggctgtagaaactaataatgaactgtatgaacaactattggaattgataagaataaatcatggactgcttgtctcaatcggtgtttctcatcctggattagaacttattaaaaatctgagcgatgatttgagaattggctccacaaaacttaccggtgctggtggcggcggttgctctttgactttgttacgaagagacattactcaagagcaaattgacagcttcaaaaagaaattgcaagatgattttagttacgagacatttgaaacagacttgggtgggactggctgctgtttgttaagcgcaaaaaatttgaataaagatcttaaaatcaaatccctagtattccaattatttgaaaataaaactaccacaaagcaacaaattgacgatctattattgccaggaaacacgaatttaccatggacttcataa

SEQ ID NO: 64 - protein, 443 aa, Saccharomyces sp.
MSLPFLTSAPGKVIIFGEHSAVYNKPAVAASVSALRTYLLISESSAPDTIELDFPDISFNHKWSINDFNAITEDQVNSQKLAKAQQATDGLSQELVSLLDPLLAQLSESFHYHAAFCFLYMFVCLCPHAKNIKFSLKSTLPIGAGLGSSASISVSLALAMAYLGGLIGSNDLEKLSENDKHIVNQWAFIGEKCIHGTPSGIDNAVATYGNALLFEKDSHNGTINTNNFKFLDDFPAIPMILTYTRIPRSTKDLVARVRVLVTEKFPEVMKPILDAMGECALQGLEIMTKLSKCKGTDDEAVETNNELYEQLLELIRINHGLLVSIGVSHPGLELIKNLSDDLRIGSTKLTGAGGGGCSLTLLRRDITQEQIDSFKKKLQDDFSYETFETDLGGTGCCLLSAKNLNKDLKIKSLVFQLFENKTTTKQQIDDLLLPGNTNLPWTS

SEQ ID NO: 65 - DNA, 1191 bp, Saccharomyces sp.
atgaccgtttacacagcatccgttaccgcacccgtcaacatcgcaacccttaagtattgggggaaaagggacacgaagttgaatctgcccaccaattcgtccatatcagtgactttatcgcaagatgacctcagaacgttgacctctgcggctactgcacctgagtttgaacgcgacactttgtggttaaatggagaaccacacagcatcgacaatgaaagaactcaaaattgtctgcgcgacctacgccaattaagaaaggaaatggaatcgaaggacgcctcattgcccacattatctcaatggaaactccacattgtctccgaaaataactttcctacagcagctggtttagcttcctccgctgctggctttgctgcattggtctctgcaattgctaagttataccaattaccacagtcaacttcagaaatatctagaatagcaagaaaggggtctggttcagcttgtagatcgttgtttggcggatacgtggcctgggaaatgggaaaagctgaagatggtcatgattccatggcagtacaaatcgcagacagctctgactggcctcagatgaaagcttgtgtcctagttgtcagcgatattaaaaaggatgtgagttccactcagggtatgcaattgaccgtggcaacctccgaactatttaaagaaagaattgaacatgtcgtaccaaagagatttgaagtcatgcgtaaagccattgttgaaaaagatttcgccacctttgcaaaggaaacaatgatggattccaactctttccatgccacatgtttggactctttccctccaatattctacatgaatgacacttccaagcgtatcatcagttggtgccacaccattaatcagttttacggagaaacaatcgttgcatacacgtttgatgcaggtccaaatgctgtgttgtactacttagctgaaaatgagtcgaaactctttgcatttatctataaattgtttggctctgttcctggatgggacaagaaatttactactgagcagcttgaggctttcaaccatcaatttgaatcatctaactttactgcacgtgaattggatcttgagttgcaaaaggatgttgccagagtgattttaactcaagtcggttcaggcccacaagaaacaaacgaatctttgattgacgcaaagactggtctaccaaaggaataa

SEQ ID NO: 66 - protein, 396 aa, Saccharomyces sp.
MTVYTASVTAPVNIATLKYWGKRDTKLNLPTNSSISVTLSQDDLRTLTSAATAPEFERDTLWLNGEPHSIDNERTQNCLRDLRQLRKEMESKDASLPTLSQWKLHIVSENNFPTAAGLASSAAGFAALVSAIAKLYQLPQSTSEISRIARKGSGSACRSLFGGYVAWEMGKAEDGHDSMAVQIADSSDWPQMKACVLVVSDIKKDVSSTQGMQLTVATSELFKERIEHVVPKRFEVMRKAIVEKDFATFAKETMMDSNSFHATCLDSFPPIFYMNDTSKRIISWCHTINQFYGETIVAYTFDAGPNAVLYYLAENESKLFAFIYKLFGSVPGWDKKFTTEQLEAFNHQFESSNFTARELDLELQKDVARVILTQVGSGPQETNESLIDAKTGLPKE

SEQ ID NO: 67 - DNA, 2751 bp, Artificial Sequence
  Engineered phosphomevalonate kinase/mevalonate kinase (Erg8-T2A-Erg12)
atgtcagagttgagagccttcagtgccccagggaaagcgttactagctggtggatatttagttttagatacaaaatatgaagcatttgtagtcggattatcggcaagaatgcatgctgtagcccatccttacggttcattgcaagggtctgataagtttgaagtgcgtgtgaaaagtaaacaatttaaagatggggagtggctgtaccatataagtcctaaaagtggcttcattcctgtttcgataggcggatctaagaaccctttcattgaaaaagttatcgctaacgtatttagctactttaaacctaacatggacgactactgcaatagaaacttgttcgttattgatattttctctgatgatgcctaccattctcaggaggatagcgttaccgaacatcgtggcaacagaagattgagttttcattcgcacagaattgaagaagttcccaaaacagggctgggctcctcggcaggtttagtcacagttttaactacagctttggcctccttttttgtatcggacctggaaaataatgtagacaaatatagagaagttattcataatttagcacaagttgctcattgtcaagctcagggtaaaattggaagcgggtttgatgtagcggcggcagcatatggatctatcagatatagaagattcccacccgcattaatctctaatttgccagatattggaagtgctacttacggcagtaaactggcgcatttggttgatgaagaagactggaatattacgattaaaagtaaccatttaccttcgggattaactttatggatgggcgatattaagaatggttcagaaacagtaaaactggtccagaaggtaaaaaattggtatgattcgcatatgccagaaagcttgaaaatatatacagaactcgatcatgcaaattctagatttatggatggactatctaaactagatcgcttacacgagactcatgacgattacagcgatcagatatttgagtctcttgagaggaatgactgtacctgtcaaaagtatcctgaaatcacagaagttagagatgcagttgccacaattagacgttcctttagaaaaataactaaagaatctggtgccgatatcgaacctcccgtacaaactagcttattggatgattgccagaccttaaaaggagttcttacttgcttaatacctggtgctggtggttatgacgccattgcagtgattactaagcaagatgttgatcttagggctcaaaccgctaatgacaaaagattttctaaggttcaatggctggatgtaactcaggctgactggggtgttaggaaagaaaaagatccggaaacttatcttgataaaaagcttgagggcagaggaagtcttctaacatgcggtgacgtggaggagaatcccggccctgctagcatgtcattaccgttcttaacttctgcaccgggaaaggttattatttttggtgaacactctgctgtgtacaacaagcctgccgtcgctgctagtgtgtctgcgttgagaacctacctgctaataagcgagtcatctgcaccagatactattgaattggacttcccggacattagctttaatcataagtggtccatcaatgatttcaatgccatcaccgaggatcaagtaaactcccaaaaattggccaaggctcaacaagccaccgatggcttgtctcaggaactcgttagtcttttggatccgttgttagctcaactatccgaatccttccactaccatgcagcgttttgtttcctgtatatgtttgtttgcctatgcccccatgccaagaatattaagttttctttaaagtctactttacccatcggtgctgggttgggctcaagcgcctctatttctgtatcactggccttagctatggcctacttgggggggttaataggatctaatgacttggaaaagctgtcagaaaacgataagcatatagtgaatcaatgggccttcataggtgaaaagtgtattcacggtaccccttcaggaatagataacgctgtggccacttatggtaatgccctgctatttgaaaaagactcacataatggaacaataaacacaaacaattttaagttcttagatgatttcccagccattccaatgatcctaacctatactagaattccaaggtctacaaaagatcttgttgctcgcgttcgtgtgttggtcaccgagaaatttcctgaagttatgaagccaattctagatgccatgggtgaatgtgccctacaaggcttagagatcatgactaagttaagtaaatgtaaaggcaccgatgacgaggctgtagaaactaataatgaactgtatgaacaactattggaattgataagaataaatcatggactgcttgtctcaatcggtgtttctcatcctggattagaacttattaaaaatctgagcgatgatttgagaattggctccacaaaacttaccggtgctggtggcggcggttgctctttgactttgttacgaagagacattactcaagagcaaattgacagcttcaaaaagaaattgcaagatgattttagttacgagacatttgaaacagacttgggtgggactggctgctgtttgttaagcgcaaaaaatttgaataaagatcttaaaatcaaatccctagtattccaattatttgaaaataaaactaccacaaagcaacaaattgacgatctattattgccaggaaacacgaatttaccatggacttcataa

SEQ ID NO: 68 - protein, 916 aa, Artificial Sequence
  Engineered phosphomevalonate kinase/mevalonate kinase (Erg8-T2A-Erg12)
MSELRAFSAPGKALLAGGYLVLDTKYEAFVVGLSARMHAVAHPYGSLQGSDKFEVRVKSKQFKDGEWLYHISPKSGFIPVSIGGSKNPFIEKVIANVFSYFKPNMDDYCNRNLFVIDIFSDDAYHSQEDSVTEHRGNRRLSFHSHRIEEVPKTGLGSSAGLVTVLTTALASFFVSDLENNVDKYREVIHNLAQVAHCQAQGKIGSGFDVAAAAYGSIRYRRFPPALISNLPDIGSATYGSKLAHLVDEEDWNITIKSNHLPSGLTLWMGDIKNGSETVKLVQKVKNWYDSHMPESLKIYTELDHANSRFMDGLSKLDRLHETHDDYSDQIFESLERNDCTCQKYPEITEVRDAVATIRRSFRKITKESGADIEPPVQTSLLDDCQTLKGVLTCLIPGAGGYDAIAVITKQDVDLRAQTANDKRFSKVQWLDVTQADWGVRKEKDPETYLDKKLEGRGSLLTCGDVEENPGPASMSLPFLTSAPGKVIIFGEHSAVYNKPAVAASVSALRTYLLISESSAPDTIELDFPDISFNHKWSINDFNAITEDQVNSQKLAKAQQATDGLSQELVSLLDPLLAQLSESFHYHAAFCFLYMFVCLCPHAKNIKFSLKSTLPIGAGLGSSASISVSLALAMAYLGGLIGSNDLEKLSENDKHIVNQWAFIGEKCIHGTPSGIDNAVATYGNALLFEKDSHNGTINTNNFKFLDDFPAIPMILTYTRIPRSTKDLVARVRVLVTEKFPEVMKPILDAMGECALQGLEIMTKLSKCKGTDDEAVETNNELYEQLLELIRINHGLLVSIGVSHPGLELIKNLSDDLRIGSTKLTGAGGGGCSLTLLRRDITQEQIDSFKKKLQDDFSYETFETDLGGTGCCLLSAKNLNKDLKIKSLVFQLFENKTTTKQQIDDLLLPGNTNLPWTS

SEQ ID NO: 69 - DNA, 756 bp, Artificial Sequence
  Artificial neryl pyrophosphate (NPP) synthase (NPPS) nucleotide sequence
atgtgctcacttaatttgcaaacggaaaagctatgctatgaagacaatgacaatgacttggacgaggaactgatgccgaagcacatagcgctaatcatggatggtaatagacgttgggcaaaagacaagggcttagaagtgtacgaagggcacaaacatataatcccgaaactaaaagaaatatgtgacatatcctccaagttggggattcagatcatcacagcgttcgcgttctccacagagaactggaagagatccaaggaggaagtcgatttcctattgcagatgtttgaagaaatctatgacgaatttagccgttctggggtgagagtgagtatcatcggatgcaaaagcgatttgccgatgacccttcaaaaatgtatcgcattgacagaggaaacgacgaaaggcaataagggattacacctggtcatagcacttaactacggtgggtattacgatatcctacaagcaacgaagtccattgtaaacaaggctatgaatggtttattggacgttgaagacatcaataaaaatctgttcgaccaagaattagaaagcaaatgccctaaccctgacttgctgatcagaactgggggagaacagagggtctctaattttcttctatggcaattggcttatactgagttctattttaccaatactttattccctgactttggtgaagaggacctgaaagaagccatcatgaattttcaacagagacaccgtagattcggaggacatacttattga

SEQ ID NO: 70 - protein, 251 aa, Solanum sp.
MCSLNLQTEKLCYEDNDNDLDEELMPKHIALIMDGNRRWAKDKGLEVYEGHKHIIPKLKEICDISSKLGIQIITAFAFSTENWKRSKEEVDFLLQMFEEIYDEFSRSGVRVSIIGCKSDLPMTLQKCIALTEETTKGNKGLHLVIALNYGGYYDILQATKSIVNKAMNGLLDVEDINKNLFDQELESKCPNPDLLIRTGGEQRVSNFLLWQLAYTEFYFTNTLFPDFGEEDLKEAIMNFQQRHRRFGGHTY

SEQ ID NO: 71 - DNA, 1113 bp, Artificial Sequence
  Artificial geranylgeranyl pyrophosphate synthase large subunit (GPPSlsu) nucleotide sequence
atgagcaccgtgaatctgacctgggtgcagacgtgctctatgttcaaccagggcgggcgttcccgttcattgtcaaccttcaacttaaatctgtaccatccattgaagaaaacgcctttctctatccagacacctaagcagaaaaggccaacttcccccttctcatctatcagtgccgtattaacggagcaggaagcagtaaaggagggtgacgaggaaaaaagcatatttaacttcaaatcttatatggttcagaaagctaatagcgtgaatcaggcactagattctgcggtgttattgagagaccccattatgatacatgaatctatgcgttactctttgcttgcgggcggcaagcgtgtcagaccgatgttatgcttaagtgcgtgcgagttagtaggaggtaaagagtctgtagcaatgcccgcagcatgtgctgtagaaatgatacacacaatgtcactgattcacgatgatcttccttgcatggataacgacgatcttcgtagaggtaagccaaccaaccacaaggtattcggggaagacgtggcagttttagcaggagacgcgctactagcgttcgcgtttgaacacatggcagttagcacagtaggagttccagcagcaaaaatagttagggctataggagagttagcaaagtccatcggtagcgagggccttgttgccggacaggtagttgatatcgatagtgaagggttggctaacgtgggactagaacaactggagttcatccacctacacaagacaggggcactgcttgaagcgagtgttgtacttggggctattctggggggaggaacagatgaggaggtagaaaaactacgtagttttgccaggtgtataggactactatttcaagttgtagatgatatccttgacgtcacgaagagtagtcaagagttaggaaaaacagcagggaaagatctagttgccgataaagtaacctaccccaggctaatgggtatcgataaatctcgtgagttcgccgaacaattaaatactgaggctaagcaacatttaagcgggtttgatcctattaaggctgcgccgctgattgctctagcaaactatattgcatatagacagaactga

SEQ ID NO: 72 - protein, 370 aa, Cannabis sativa
MSTVNLTWVQTCSMFNQGGRSRSLSTFNLNLYHPLKKTPFSIQTPKQKRPTSPFSSISAVLTEQEAVKEGDEEKSIFNFKSYMVQKANSVNQALDSAVLLRDPIMIHESMRYSLLAGGKRVRPMLCLSACELVGGKESVAMPAACAVEMIHTMSLIHDDLPCMDNDDLRRGKPTNHKVFGEDVAVLAGDALLAFAFEHMAVSTVGVPAAKIVRAIGELAKSIGSEGLVAGQVVDIDSEGLANVGLEQLEFIHLHKTGALLEASVVLGAILGGGTDEEVEKLRSFARCIGLLFQVVDDILDVTKSSQELGKTAGKDLVADKVTYPRLMGIDKSREFAEQLNTEAKQHLSGFDPIKAAPLIALANYIAYRQN

SEQ ID NO: 73 - DNA, 948 bp, Artificial Sequence
  Artificial geranylgeranyl pyrophosphate synthase small subunit (GPPSssu) nucleotide sequence
atggctgtttacaacctttcaatcaactgttctcccagattcgtccatcatgtatacgtgccccattttacatgtaaatcaaataagagcctgagccatgtccccatgagaatcacgatgtcaaagcagcatcatcactcatactttgcctctacaacggcagatgtcgatgcccatctaaaacaatcaatcacaattaaacccccgttgtctgtccacgaagccatgtataactttatcttcagtacgccaccgaatttggcgccatcattatgtgtcgcagcatgtgaattggttgggggtcaccagggacaggcgatggcagcggccagcgcattaagggtaatacatgctagcatcgttacccacgatcaccttccgttaacgggaaggccaaaccccacctcaccggaggccgctacgcacaattcctataatccaaacatacagttgttattacctgacgccattacacccttcgggtttgagctattagcgtccagtgatgatcttacacacaacaagagtgagagagttcttagggtgatcgttgaatttacgaggactttcggttccagaggcactatagacgcccaataccacgaaaagttggctagtaggtttgatgtggatagccatgaggcaaagaccgtaggatgggggcattacccatcattgaaaaaggagggagccatgcacgcatgtgctgctgcctgcggagcaatattgggtgaggctcatgaagaagaagtggaaaaattgcgtacattcgggctgtatgtcggcatgatccaaggttatgcgaacagattcatcatgagcagtacagaggagaaaaaagaggctgacaggataattgaggagcttaccaatttagcgcgtcaggagctgaaatacttcgatggaaggaacctagaaccgttttcaacattcttgttccgtttgtag

SEQ ID NO: 74 - protein, 315 aa, Cannabis sativa
MAVYNLSINCSPRFVHHVYVPHFTCKSNKSLSHVPMRITMSKQHHHSYFASTTADVDAHLKQSITIKPPLSVHEAMYNFIFSTPPNLAPSLCVAACELVGGHQGQAMAAASALRVIHASIVTHDHLPLTGRPNPTSPEAATHNSYNPNIQLLLPDAITPFGFELLASSDDLTHNKSERVLRVIVEFTRTFGSRGTIDAQYHEKLASRFDVDSHEAKTVGWGHYPSLKKEGAMHACAAACGAILGEAHEEEVEKLRTFGLYVGMIQGYANRFIMSSTEEKKEADRIIEELTNLARQELKYFDGRNLEPFSTFLFRL

SEQ ID NO: 75 - DNA, 1161 bp, Artificial Sequence
  Artificial tetraketide synthase (TKS) nucleotide sequence
atgaatcatttaagagctgaaggtccagcctccgttttggccatcggtaccgctaaccctgaaaacattttgttgcaagacgaattcccagactactacttcagagtcactaagtccgaacacatgacccaattgaaggagaagttcagaaagatttgtgacaagtccatgattagaaagagaaactgtttcttgaacgaagaacacttgaagcaaaacccaagattggttgaacatgaaatgcaaactttggacgctagacaagacatgttggttgttgaagtccctaagttgggtaaggatgcctgtgctaaggccattaaagaatggggtcaacctaagtccaagattacccacttgattttcacctctgcctccaccactgacatgcctggtgctgattaccactgcgctaagttattgggtttgtctccatccgttaagagagttatgatgtaccaattgggttgctacggtggtggtactgttttaagaattgctaaggatattgctgaaaacaacaagggtgccagagtcttagctgtctgctgtgacattatggcttgtttattcagaggtccatctgaatccgacttggaattgttggttggtcaagctatcttcggtgacggtgctgctgccgttattgttggtgctgaaccagacgaatccgttggtgaaagaccaatttttgaattggtttccaccggtcaaactattttgccaaattccgaaggtaccatcggtggtcatatcagagaagccggtttgatcttcgacttacataaggatgtcccaatgttgatctctaacaacattgaaaagtgtttgatcgaagcttttaccccaattggtatttctgactggaactctatcttctggattacccatcctggtggtaaggctattttggataaggtcgaggaaaaattgcacttgaagtctgacaagttcgttgactctagacacgtcttgtccgaacatggtaatatgtcctcttccaccgttttattcgttatggatgagttgagaaagagatccttagaagaaggtaagtccaccaccggtgatggttttgagtggggtgttttgttcggtttcggtccaggtttgaccgtcgaaagagttgttgttagatctgtcccaattaagtacggatcc

SEQ ID NO: 76 - protein, 387 aa, Artificial Sequence
  Artificial tetraketide synthase (TKS)
MNHLRAEGPASVLAIGTANPENILLQDEFPDYYFRVTKSEHMTQLKEKFRKICDKSMIRKRNCFLNEEHLKQNPRLVEHEMQTLDARQDMLVVEVPKLGKDACAKAIKEWGQPKSKITHLIFTSASTTDMPGADYHCAKLLGLSPSVKRVMMYQLGCYGGGTVLRIAKDIAENNKGARVLAVCCDIMACLFRGPSESDLELLVGQAIFGDGAAAVIVGAEPDESVGERPIFELVSTGQTILPNSEGTIGGHIREAGLIFDLHKDVPMLISNNIEKCLIEAFTPIGISDWNSIFWITHPGGKAILDKVEEKLHLKSDKFVDSRHVLSEHGNMSSSTVLFVMDELRKRSLEEGKSTTGDGFEWGVLFGFGPGLTVERVVVRSVPIKYGS

SEQ ID NO: 77 - DNA, 309 bp, Artificial Sequence
  Artificial olivetolic acid cyclase (OAC) nucleotide sequence
atggccgtcaagcacttgatcgttttgaagttcaaggatgaaatcactgaagctcaaaaggaagaattcttcaaaacctacgtcaacttagtcaatattattccagccatgaaggacgtctattggggtaaggacgttactcaaaagaataaggaggaaggttatactcatatcgttgaggtcactttcgaatctgttgagactattcaagactacatcatccacccagcccacgttggtttcggtgatgtttatcgttccttctgggaaaaattgttgatcttcgactacacccctagaaagggatcc

SEQ ID NO: 78 - protein, 103 aa, Artificial Sequence
  Artificial olivetolic acid cyclase (OAC)
MAVKHLIVLKFKDEITEAQKEEFFKTYVNLVNIIPAMKDVYWGKDVTQKNKEEGYTHIVEVTFESVETIQDYIIHPAHVGFGDVYRSFWEKLLIFDYTPRKGS

SEQ ID NO: 79 - DNA, 1578 bp, Artificial Sequence
  Fusion tetraketide synthase-olivetolic acid cyclase (TKS-OAC)
atgaatcatttaagagctgaaggtccagcctccgttttggccatcggtaccgctaaccctgaaaacattttgttgcaagacgaattcccagactactacttcagagtcactaagtccgaacacatgacccaattgaaggagaagttcagaaagatttgtgacaagtccatgattagaaagagaaactgtttcttgaacgaagaacacttgaagcaaaacccaagattggttgaacatgaaatgcaaactttggacgctagacaagacatgttggttgttgaagtccctaagttgggtaaggatgcctgtgctaaggccattaaagaatggggtcaacctaagtccaagattacccacttgattttcacctctgcctccaccactgacatgcctggtgctgattaccactgcgctaagttattgggtttgtctccatccgttaagagagttatgatgtaccaattgggttgctacggtggtggtactgttttaagaattgctaaggatattgctgaaaacaacaagggtgccagagtcttagctgtctgctgtgacattatggcttgtttattcagaggtccatctgaatccgacttggaattgttggttggtcaagctatcttcggtgacggtgctgctgccgttattgttggtgctgaaccagacgaatccgttggtgaaagaccaatttttgaattggtttccaccggtcaaactattttgccaaattccgaaggtaccatcggtggtcatatcagagaagccggtttgatcttcgacttacataaggatgtcccaatgttgatctctaacaacattgaaaagtgtttgatcgaagcttttaccccaattggtatttctgactggaactctatcttctggattacccatcctggtggtaaggctattttggataaggtcgaggaaaaattgcacttgaagtctgacaagttcgttgactctagacacgtcttgtccgaacatggtaatatgtcctcttccaccgttttattcgttatggatgagttgagaaagagatccttagaagaaggtaagtccaccaccggtgatggttttgagtggggtgttttgttcggtttcggtccaggtttgaccgtcgaaagagttgttgttagatctgtcccaattaagtacgcagccacaagcggttctacgggctccacgggctctaccggcagtgggaggagcactgggtcaacgggatcaacaggtagtggaagatcacacatggttgccgtcaagcacttgatcgttttgaagttcaaggatgaaatcactgaagctcaaaaggaagaattcttcaaaacctacgtcaacttagtcaatattattccagccatgaaggacgtctattggggtaaggacgttactcaaaagaataaggaggaaggttatactcatatcgttgaggtcactttcgaatctgttgagactattcaagactacatcatccacccagcccacgttggtttcggtgatgtttatcgttccttctgggaaaaattgttgatcttcgactacacccctagaaagggtaactcgagagcttttgattaa

SEQ ID NO: 80 - protein, 525 aa, Artificial Sequence
  Fusion tetraketide synthase-olivetolic acid cyclase (TKS-OAC)
MNHLRAEGPASVLAIGTANPENILLQDEFPDYYFRVTKSEHMTQLKEKFRKICDKSMIRKRNCFLNEEHLKQNPRLVEHEMQTLDARQDMLVVEVPKLGKDACAKAIKEWGQPKSKITHLIFTSASTTDMPGADYHCAKLLGLSPSVKRVMMYQLGCYGGGTVLRIAKDIAENNKGARVLAVCCDIMACLFRGPSESDLELLVGQAIFGDGAAAVIVGAEPDESVGERPIFELVSTGQTILPNSEGTIGGHIREAGLIFDLHKDVPMLISNNIEKCLIEAFTPIGISDWNSIFWITHPGGKAILDKVEEKLHLKSDKFVDSRHVLSEHGNMSSSTVLFVMDELRKRSLEEGKSTTGDGFEWGVLFGFGPGLTVERVVVRSVPIKYAATSGSTGSTGSTGSGRSTGSTGSTGSGRSHMVAVKHLIVLKFKDEITEAQKEEFFKTYVNLVNIIPAMKDVYWGKDVTQKNKEEGYTHIVEVTFESVETIQDYIIHPAHVGFGDVYRSFWEKLLIFDYTPRKGNSRAFD

SEQ ID NO: 81 - DNA, 1185 bp, Cannabis sativa
atgggattgtccagcgtgtgcaccttctcattccaaaccaactaccatacacttctcaatccgcacaataataacccgaaaaccagcttattatgttatagacacccgaagacgcctattaagtacagttataacaactttcctagcaagcattgctctactaaaagttttcatctgcaaaacaagtgctctgagtccttgagtatagcaaagaatagcattagagctgcaacgacaaatcaaaccgagccgccggagtctgataaccatagtgtggcgaccaagatactaaattttggcaaagcgtgttggaagctacaacgaccttatactattatcgcgtttacgagttgtgcatgtgggctgttcgggaaagagctcttgcacaatacaaacttaatcagttggagtttgatgttcaaagcatttttttttctcgtcgctatcttatgtatcgcgtcatttaccacgaccataaatcaaatatacgatctgcatatcgatcgtatcaataagcccgacctcccactggcctcaggtgaaatttccgttaacacggcgtggattatgagtataatcgtagcactatttggacttattataaccatcaaaatgaagggcggtcctctatacatttttggatattgttttgggatttttggaggtatagtctattccgtccccccattcagatggaaacaaaacccgtccaccgctttccttttaaatttcttggcacatatcatcacaaacttcacgttttactatgccagccgagccgcactgggactcccgttcgagttgcgtccgtcattcaccttccttttagcttttatgaaatctatgggaagcgctttagctttaattaaggacgcgagcgacgtggaaggggacacgaaattcggtataagcacgctggcttcaaaatatggaagtcgtaatctcactctattttgttctgggattgtactcctaagttacgtagctgcgatactcgcaggcattatatggccacaagctttcaactccaacgtaatgttgctatcacatgcaatcttggccttctggctcatccttcaaactagagattttgcactaacgaactacgatccagaagcgggtcgtcgattttacgaatttatgtggaaactgtactatgctgagtacctcgtctatgtgttcata

SEQ ID NO: 82 - protein, 395 aa, Cannabis sativa
MGLSSVCTFSFQTNYHTLLNPHNNNPKTSLLCYRHPKTPIKYSYNNFPSKHCSTKSFHLQNKCSESLSIAKNSIRAATTNQTEPPESDNHSVATKILNFGKACWKLQRPYTIIAFTSCACGLFGKELLHNTNLISWSLMFKAFFFLVAILCIASFTTTINQIYDLHIDRINKPDLPLASGEISVNTAWIMSIIVALFGLIITIKMKGGPLYIFGYCFGIFGGIVYSVPPFRWKQNPSTAFLLNFLAHIITNFTFYYASRAALGLPFELRPSFTFLLAFMKSMGSALALIKDASDVEGDTKFGISTLASKYGSRNLTLFCSGIVLLSYVAAILAGIIWPQAFNSNVMLLSHAILAFWLILQTRDFALTNYDPEAGRRFYEFMWKLYYAEYLVYVFI

SEQ ID NO: 83 - DNA, 921 bp, Streptomyces sp.
atgtctgaggcggcagacgtagagagagtatacgctgctatggaggaagcggctggattattgggggtggcttgtgccagagacaagatatatccgttactgtctactttccaggacactcttgtagaaggagggagtgtggtggtgtttagtatggcatcaggccgtcattcaacagagctagatttcagtatatctgtgccaacaagtcacggtgatccatacgcaaccgtagtcgagaagggtcttttcccggcaacagggcatcctgtagatgatttgcttgccgacacacagaagcacctgcccgtctccatgttcgcaatcgatggtgaggtgaccggaggatttaaaaagacttacgctttcttcccgactgacaatatgccaggagttgccgagttgagtgcaataccatccatgccgccagcagtcgcggagaacgccgaattgttcgcccgttacggcttggacaaagtccaaatgactagtatggactataaaaagaggcaggtgaatctatatttcagcgaactttctgcccaaaccttggaggcggagagcgttttagcccttgttagggagttagggctacacgtcccgaatgagttgggtttgaaattttgtaagcgtagcttttcagtatatccgacgctgaactgggaaactggaaagattgacaggctatgctttgcagtgatttctaatgaccctacgcttgtaccttcctcagacgagggcgacatcgagaaattccacaactatgccacaaaagctccgtatgcctacgtcggcgaaaaacgtactctagtatacggtttgactctgagtcccaaggaagagtattacaagctaggagcgtactatcatatcactgatgtgcaacgtggcttgctgaaagccttcgactccttagaggac

SEQ ID NO: 84 - protein, 307 aa, Streptomyces sp. [sequence omitted]

SEQ ID NO: 85 - DNA, 1635 bp, Cannabis sativa
atgaactgttccgcgtttagtttctggttcgtgtgcaagatcatcttcttttttctaagcttcaacattcaaatcagcatcgcgaatcctcaggagaacttcctgaagtgtttctcagaatacataccaaataatcccgccaatcctaaatttatatatacccaacatgatcagctatacatgagtgtattgaactctacgattcagaatctaagattcacatctgatacaacgccgaaacctctagtaatcgtgacaccgtctaatgtctcccatattcaagcttctatcttgtgctcaaagaaagtcggtcttcaaataaggacacgttctggcgggcatgacgccgagggcatgtcatatatcagccaagtaccatttgtagtcgtggatttaagaaacatgcattctataaaaatcgacgttcactcccaaacggcatgggtggaagctggagcgacactgggggaggtgtactactggatcaatgaaaagaacgaaaatttttccttccccggaggatattgtccgacagttggggtggggggccacttctctggcggcgggtacggcgctctgatgcgtaattatggactggccgcagataacataatcgacgcgcatttggtgaacgttgacgggaaggttttggataggaagtctatgggagaggacctattctgggcaattagaggcggaggaggagagaattttggtattattgctgcatggaagattaaattggttgcggtgccgagtaaaagtaccatcttttccgtcaagaaaaacatggagattcacggactagttaagctgtttaataaatggcaaaacatcgcctataagtacgacaaagatttggttctgatgacgcatttcataactaagaatataactgataatcacggcaagaataagaccactgtgcacggttattttagttcaatattccatggcggcgttgactcccttgtcgatttgatgaataagagcttccctgaattgggtatcaagaagacagactgcaaagaattctcctggattgatacgactatcttctattcaggggtcgtgaatttcaacactgcgaatttcaaaaaggagatattgttagaccgttccgcgggaaaaaaaactgcgttttctattaaactagattatgtgaaaaaaccgattcctgagacagccatggttaagattcttgaaaaattgtatgaagaggatgtcggggtcggtatgtacgtcctttacccttacggaggaatcatggaagaaatatccgaatctgcaattcctttcccgcatcgtgccggtattatgtatgagctatggtacaccgctagctgggagaagcaggaagataacgagaagcatatcaattgggtgaggtctgtgtataattttacaacaccatacgtcagtcaaaaccctagattggcctatcttaactatcgtgatctggacttgggaaaaacaaatccagaatccccaaataactacactcaagcccgtatatggggcgagaagtacttcggcaaaaatttcaatagactggtcaaagttaagacgaaagcagaccctaataatttcttccgtaacgaacaatcaattcccccgcttccgccacaccatcac

SEQ ID NO: 86 - protein, 545 aa, Cannabis sativa
MNCSAFSFWFVCKIIFFFLSFNIQISIANPQENFLKCFSEYIPNNPANPKFIYTQHDQLYMSVLNSTIQNLRFTSDTTPKPLVIVTPSNVSHIQASILCSKKVGLQIRTRSGGHDAEGMSYISQVPFVVVDLRNMHSIKIDVHSQTAWVEAGATLGEVYYWINEKNENFSFPGGYCPTVGVGGHFSGGGYGALMRNYGLAADNIIDAHLVNVDGKVLDRKSMGEDLFWAIRGGGGENFGIIAAWKIKLVAVPSKSTIFSVKKNMEIHGLVKLFNKWQNIAYKYDKDLVLMTHFITKNITDNHGKNKTTVHGYFSSIFHGGVDSLVDLMNKSFPELGIKKTDCKEFSWIDTTIFYSGVVNFNTANFKKEILLDRSAGKKTAFSIKLDYVKKPIPETAMVKILEKLYEEDVGVGMYVLYPYGGIMEEISESAIPFPHRAGIMYELWYTASWEKQEDNEKHINWVRSVYNFTTPYVSQNPRLAYLNYRDLDLGKTNPESPNNYTQARIWGEKYFGKNFNRLVKVKTKADPNNFFRNEQSIPPLPPHHH

SEQ ID NO: 87 - DNA, 1632 bp, Cannabis sativa
atgaaatgttctactttcagtttttggttcgtgtgtaagatcatctttttctttttcagcttcaatatacagacaagtatcgccaatccaagagaaaatttcttaaaatgtttttcacagtacatccctaataacgccactaacctgaaattagtgtacacccaaaataatcctctttatatgtctgttttaaactccacgatccataatttaaggtttacatcagatacgacaccaaagcccttggtaatcgtgactcccagccacgtgagccacatacaggggaccatcctgtgctctaagaaagtaggcttgcagatcaggacaagatccggtggacacgacagtgagggaatgtcctatatttcacaagtccccttcgttatagtagatctgaggaacatgaggtccattaagattgatgtgcactcacaaacggcttgggttgaagctggagccacattgggagaggtttattactgggtgaatgagaagaacgagaacctttcattagcagcgggatattgtcccacggtgtgcgcaggtgggcatttcgggggaggagggtacggccctttgatgagaaattacgggctagcggcagacaacatcatcgacgcccatctggtgaacgtgcatggaaaagtactggacagaaagtcaatgggcgaggacctgttttgggctttgagagggggcggtgcagagtcatttggcatcatagttgcatggaaaatcagacttgttgccgtcccaaagtccacaatgttctctgttaagaaaatcatggagatacacgaattggtgaaattagtgaataaatggcaaaacatagcgtacaagtacgacaaagacttactgctgatgacacactttatcacccgtaatattacagataatcagggtaagaacaaaaccgcgatccatacatatttttcatccgtttttctaggcggtgtcgattcattagtagatctgatgaacaaatctttccccgaacttggtatcaaaaagactgattgcagacagttatcatggattgatacaataattttctattctggtgtcgtaaattacgataccgataattttaataaggaaatactattagatcgttccgctgggcagaatggtgcattcaagataaaacttgattatgtcaaaaagcccattccagagagtgtctttgtgcagatccttgagaagttgtatgaagaagacattggtgcagggatgtacgcgctatatccgtacgggggtattatggacgagatttctgagagcgccataccattcccacacagagcaggaattttatacgagttatggtatatctgctcatgggaaaaacaggaagacaacgagaagcacttaaactggatacgtaatatctataattttatgaccccatacgtatcaaaaaatccgcgtcttgcgtaccttaactacagggacctggacataggtataaacgacccaaaaaatcccaataattacacccaagctagaatctggggggagaagtatttcggtaagaactttgaccgtttggtaaaagtcaaaactctggtcgatccgaacaatttcttccgtaacgagcaatccatacctccgctaccgagacatagacat

SEQ ID NO: 88 - protein, 544 aa, Cannabis sativa
MKCSTFSFWFVCKIIFFFFSFNIQTSIANPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 89 - DNA, 2160 bp, Cannabis sativa
atgggaaaaaactacaaaagtctggactccgtcgtcgcgtcagacttcattgccctaggcataacatcagaggtagcggaaaccttacacggcagactagccgagattgtttgtaactacggggcggctactccccagacttggatcaatatagccaatcacatattaagccccgatttgccgttttcccttcaccaaatgttgttctacggctgctataaggactttggaccagcgccccccgcgtggattcctgatccggagaaagttaaatccacgaatcttggggcattactagaaaaacgtggcaaagaattcctaggagttaaatataaggaccccatatcttccttttcacactttcaagaattttcagttagaaacccagaggtttactggaggacagtattaatggatgagatgaagataagctttagtaaggatccggagtgtattctgcgtagagatgacattaacaatcctggcggaagtgaatggctgcctggtgggtacctgaatagtgctaagaactgtttaaacgtcaactctaataaaaaattgaatgatacaatgattgtatggagagacgaagggaacgatgacctaccattgaacaagctgactctagatcagctacgtaaacgtgtatggttggtcgggtacgcgctggaggagatgggattagaaaaaggatgcgcaattgctatcgacatgcctatgcatgtggacgcggtagtcatttacttggccattgtcctagcgggttacgtcgtcgtttcaattgcagacagcttttctgcacccgaaatcagtacccgtctgcgtttgtctaaagctaaggcaatatttacccaagaccatataattagaggcaagaagcgtataccgttgtacagtagggttgtagaggcaaagtcacccatggctattgtgataccatgctctggctctaatataggagcggagcttagagatggtgacatctcctgggattactttcttgaacgtgctaaggagtttaaaaactgtgaatttactgcaagagagcagcccgtggatgcatacacaaacatattgttctccagcggtactacgggagaacctaaagcaataccttggacacaagctacaccccttaaagcggccgctgacggatggtcccacctggatatcaggaagggtgacgtcatagtttggccgactaacctgggatggatgatgggcccttggctggtttacgctagccttctgaatggggccagcattgcattgtacaatggctcaccgcttgtatcaggcttcgcgaagttcgtacaggacgccaaggtaacaatgctaggcgtagttccgtccatagttaggtcttggaagagcacgaactgcgttagtggctacgattggagcactattcgttgtttcagctcttctggcgaggccagcaacgttgatgaatatttgtggttgatggggagagcgaactacaaacctgttattgagatgtgcggcggaactgagattgggggagcattctccgccggttcttttctacaagcccaaagtttatcctcttttagcagccagtgcatgggctgtacactatacattctggacaaaaatggttatccgatgccgaaaaacaagcccggcatcggagaactggccctaggacccgtgatgttcggcgctagtaagacgttgttgaatgggaatcaccacgacgtttattttaagggaatgccaactttgaatggcgaagtacttcgtagacacggagacatctttgagttgacttcaaacggttactaccacgctcatggacgtgccgatgatacgatgaacattgggggaattaaaatttcatccatagaaatagaacgtgtgtgtaacgaagtcgatgatcgtgtattcgagactacagcgatcggtgtcccaccgttgggtgggggaccagaacaattggtaatcttttttgttctgaaagactccaacgatacgaccatcgacctaaatcagctgaggctatcctttaatctgggcttgcagaaaaagctaaatcctttattcaaagtcactagagttgttcctttatcttcattaccaagaactgcaacaaataaaataatgcgtagagttctaaggcagcagtttagtcatttcgaa

SEQ ID NO: 90 - protein, 720 aa, Cannabis sativa
MGKNYKSLDSVVASDFIALGITSEVAETLHGRLAEIVCNYGAATPQTWINIANHILSPDLPFSLHQMLFYGCYKDFGPAPPAWIPDPEKVKSTNLGALLEKRGKEFLGVKYKDPISSFSHFQEFSVRNPEVYWRTVLMDEMKISFSKDPECILRRDDINNPGGSEWLPGGYLNSAKNCLNVNSNKKLNDTMIVWRDEGNDDLPLNKLTLDQLRKRVWLVGYALEEMGLEKGCAIAIDMPMHVDAVVIYLAIVLAGYVVVSIADSFSAPEISTRLRLSKAKAIFTQDHIIRGKKRIPLYSRVVEAKSPMAIVIPCSGSNIGAELRDGDISWDYFLERAKEFKNCEFTAREQPVDAYTNILFSSGTTGEPKAIPWTQATPLKAAADGWSHLDIRKGDVIVWPTNLGWMMGPWLVYASLLNGASIALYNGSPLVSGFAKFVQDAKVTMLGVVPSIVRSWKSTNCVSGYDWSTIRCFSSSGEASNVDEYLWLMGRANYKPVIEMCGGTEIGGAFSAGSFLQAQSLSSFSSQCMGCTLYILDKNGYPMPKNKPGIGELALGPVMFGASKTLLNGNHHDVYFKGMPTLNGEVLRRHGDIFELTSNGYYHAHGRADDTMNIGGIKISSIEIERVCNEVDDRVFETTAIGVPPLGGGPEQLVIFFVLKDSNDTTIDLNQLRLSFNLGLQKKLNPLFKVTRVVPLSSLPRTATNKIMRRVLRQQFSHFE

SEQ ID NO: 91 - DNA, 1599 bp, Cannabis sativa
atggaaaagtctggttatggtagagatggtatctacaggtctttaagaccaccattgcatttgccaaacaacaacaacttgtccatggtcagtttcttgttcagaaactcttcttcctacccacaaaaaccagccttgattgactctgaaactaatcaaatcttgtccttctcccacttcaaatccaccgttattaaggtttctcacggtttcttgaacttgggtatcaagaagaatgactggttgatctacgctccaaactctattcatttcccagtttgctttttgggtattattgcttctggtgctattgctactacttccaacccattatacaccgtcagtgaattgtctaagcaagtcaaggattctaacccaaagttgattatcaccgttccacaattattggaaaaggtcaagggtttcaacttgccaaccattttgattggtccagactcagaacaagaatcctcttcagataaggttatgaccttcaacgatttggttaacttgggtggttcttctggttctgaatttccaatcgttgatgacttcaagcaatctgatactgctgctttgttgtactcttctggtactactggtatgtctaaaggttggttgactcacaagaactttatcgcctcttctttgatggttaccatggaacaagacttggttggtgaaatggataacgttttcttgtgcttcttgccaatgttccatgttttcggtttggccattattacctacgctcaattgcaaagaggtaacactgttatttccgccagattcgatttggaaaagatgttgaaggacgtcgaaaagtatgttactcatttgtggtggcctccagttattttggctttgtctaaaaactccatggttaagttcaacttgtcatccatcaagtacattggttcaggtgctgctccattgggtaaggatttgatggaagaatgttctaaatggccatacggtatagttgctcaaggttacggtatgactgaaacttgtggtatcgtttctatggaagatatcagaggtggtaagagaaattctggttcagctggtatgttggcttcaggtgttgaagctcaaatagtttctgttgataccttgaaaccattgccaccaaatcaattgggtgaaatttgggttaagggtccaaatatgatgcaaggttacttcaacaatccacaagctaccaagttgaccattgataagaaaggttgggttcatactggtgacttgggttactttgatgaagatggtcacttgtactgggacagaatcaaagaattgattaagtacaagggttttcaagtcgctccagctgaattggaaggtttgttggtttctcatccagaaatattggatgcctggattccatttccagatgctgaagctggtgaagttccagttgcttattggagatcaccaaactcttcattgactgaaaacgacgtcaagaagttcattgctggtcaagttgcttctttcaagagattgagaaaggtcaccttcatcaactctgttccaaaatctgcttccggtaagatcttgagaagagaattgatccaaaaggtcagatccaatatg

SEQ ID NO: 92 - protein, 533 aa, Cannabis sativa
MEKSGYGRDGIYRSLRPPLHLPNNNNLSMVSFLFRNSSSYPQKPALIDSETNQILSFSHFKSTVIKVSHGFLNLGIKKNDWLIYAPNSIHFPVCFLGIIASGAIATTSNPLYTVSELSKQVKDSNPKLIITVPQLLEKVKGFNLPTILIGPDSEQESSSDKVMTFNDLVNLGGSSGSEFPIVDDFKQSDTAALLYSSGTTGMSKGWLTHKNFIASSLMVTMEQDLVGEMDNVFLCFLPMFHVFGLAIITYAQLQRGNTVISARFDLEKMLKDVEKYVTHLWWPPVILALSKNSMVKFNLSSIKYIGSGAAPLGKDLMEECSKWPYGIVAQGYGMTETCGIVSMEDIRGGKRNSGSAGMLASGVEAQIVSVDTLKPLPPNQLGEIWVKGPNMMQGYFNNPQATKLTIDKKGWVHTGDLGYFDEDGHLYWDRIKELIKYKGFQVAPAELEGLLVSHPEILDAWIPFPDAEAGEVPVAYWRSPNSSLTENDVKKFIAGQVASFKRLRKVTFINSVPKSASGKILRRELIQKVRSNM

SEQ ID NO: 93 - DNA, 744 bp, Artificial Sequence
  Artificial acetoacetyl-CoA reductase (PhaB) nucleotide sequence
atgacgcagagaatcgcctatgtaacgggtgggatgggtgggataggaaccgccatatgtcagagactagcaaaggacggattcagggttgtagccggttgcggtcctaatagtccaagaagagagaaatggttggaacagcaaaaagctctaggatttgattttatagcatcagaagggaatgttgctgactgggattctacaaagacggcatttgacaaagtgaaatctgaagtcggcgaggtcgatgtcctaattaacaacgccggcatcaccagagatgtggttttcaggaagatgactagggctgactgggacgccgtgatagacacaaatttgacgagcttgttcaacgtcacaaagcaagtaattgacggcatggcagatcgtgggtggggaaggatagtcaatatctccagcgtcaacggtcagaaaggccagttcggacagactaactactccacagcgaaggctggcttacacggattcacgatggccttggcccaagaggtggctactaaaggggtgactgtgaacacagtgtcaccaggatacatcgcgacggatatggtcaaagctattagacaagatgtcctggacaagattgttgccactattcccgtaaagaggcttgggttaccagaagagatagcttcaatttgcgcttggctatctagtgaggaatcagggttcagcactggggcggacttttcattaaacggtggattacacatgggaggatcc

SEQ ID NO: 94 - protein, 248 aa, Artificial Sequence
  Mutant acetoacetyl-CoA reductase (PhaB)
MTQRIAYVTGGMGGIGTAICQRLAKDGFRVVAGCGPNSPRREKWLEQQKALGFDFIASEGNVADWDSTKTAFDKVKSEVGEVDVLINNAGITRDVVFRKMTRADWDAVIDTNLTSLFNVTKQVIDGMADRGWGRIVNISSVNGQKGQFGQTNYSTAKAGLHGFTMALAQEVATKGVTVNTVSPGYIATDMVKAIRQDVLDKIVATIPVKRLGLPEEIASICAWLSSEESGFSTGADFSLNGGLHMGGS

SEQ ID NO: 95 - DNA, 408 bp, Artificial Sequence
  Artificial (R)-specific enoyl-CoA hydratase (PhaJ)
atgtctgcccagagtctggaagtcggtcaaaaagcaagactgtcaaaaagatttggggcggcagaggtagcggcgttcgcggcgctgtctgaggattttaatccactgcacttagatcctgcgttcgccgcgacaacagcattcgagaggcccatcgtgcacggcatgctacttgcctctttgttctcaggtctactgggtcaacagttacctgggaaaggaagcatctatctgggacagtcattgtcttttaagctgcccgtcttcgtcggcgatgaggtgacagcagaagtagaagtcacagcattgagggaagacaagcctattgcgacccttactactcgtatttttactcagggcggagccttagcagtgacaggagaagctgtagtaaaactaccaggatcc

SEQ ID NO: 96 - protein, 136 aa, Artificial Sequence
  Mutant (R)-specific enoyl-CoA hydratase (PhaJ)
MSAQSLEVGQKARLSKRFGAAEVAAFAALSEDFNPLHLDPAFAATTAFERPIVHGMLLASLFSGLLGQQLPGKGSIYLGQSLSFKLPVFVGDEVTAEVEVTALREDKPIATLTTRIFTQGGALAVTGEAVVKLPGS

SEQ ID NO: 97 - protein, 2233 aa, Artificial Sequence
  Mutated acetyl-CoA carboxylase (ACC1) (S659A, S1157A)
MSEESLFESSPQKMEYEITNYSERHTELPGHFIGLNTVDKLEESPLRDFVKSHGGHTVISKILIANNGIAAVKEIRSVRKWAYETFGDDRTVQFVAMATPEDLEANAEYIRMADQYIEVPGGTNNNNYANVDLIVDIAERADVDAVWAGWGHASENPLLPEKLSQSKRKVIFIGPPGNAMRSLGDKISSTIVAQSAKVPCIPWSGTGVDTVHVDEKTGLVSVDDDIYQKGCCTSPEDGLQKAKRIGFPVMIKASEGGGGKGIRQVEREEDFIALYHQAANEIPGSPIFIMKLAGRARHLEVQLLADQYGTNISLFGRDCSVQRRHQKIIEEAPVTIAKAETFHEMEKAAVRLGKLVGYVSAGTVEYLYSHDDGKFYFLELNPRLQVEHPTTEMVSGVNLPAAQLQIAMGIPMHRISDIRTLYGMNPHSASEIDFEFKTQDATKKQRRPIPKGHCTACRITSEDPNDGFKPSGGTLHELNFRSSSNVWGYFSVGNNGNIHSFSDSQFGHIFAFGENRQASRKHMVVALKELSIRGDFRTTVEYLIKLLETEDFEDNTITTGWLDDLITHKMTAEKPDPTLAVICGAATKAFLASEEARHKYIESLQKGQVLSKDLLQTMFPVDFIHEGKRYKFTVAKSGNDRYTLFINGSKCDIILRQLADGGLLIAIGGKSHTIYWKEEVAATRLSVDSMTTLLEVENDPTQLRTPSPGKLVKFLVENGEHIIKGQPYAEIEVMKMQMPLVSQENGIVQLLKQPGSTIVAGDIMAIMTLDDPSKVKHALPFEGMLPDFGSPVIEGTKPAYKFKSLVSTLENILKGYDNQVIMNASLQQLIEVLRNPKLPYSEWKLHISALHSRLPAKLDEQMEELVARSLRRGAVFPARQLSKLIDMAVKNPEYNPDKLLGAVVEPLADIAHKYSNGLEAHEHSIFVHFLEEYYEVEKLFNGPNVREENIILKLRDENPKDLDKVALTVLSHSKVSAKNNLILAILKHYQPLCKLSSKVSAIFSTPLQHIVELESKATAKVALQAREILIQGALPSVKERTEQIEHILKSSVVKVAYGSSNPKRSEPDLNILKDLIDSNYVVFDVLLQFLTHQDPVVTAAAAQVYIRRAYRAYTIGDIRVHEGVTVPIVEWKFQLPSAAFSTFPTVKSKMGMNRAVSVADLSYVANSQSSPLREGILMAVDHLDDVDEILSQSLEVIPRHQSSSNGPAPDRSGSSASLSNVANVCVASTEGFESEEEILVRLREILDLNKQELINASIRRITFMFGFKDGSYPKYYTFNGPNYNENETIRHIEPALAFQLELGRLSNFNIKPIFTDNRNIHVYEAVSKTSPLDKRFFTRGIIRTGHIRDDISIQEYLTSEANRLMSDILDNLEVTDTSNSDLNHIFINFIAVFDISPEDVEAAFGGFLERFGKRLLRLRVSSAEIRIIIKDPQTGAPVPLRALINNVSGYVIKTEMYTEVKNAKGEWVFKSLGKPGSMHLRPIATPYPVKEWLQPKRYKAHLMGTTYVYDFPELFRQASSSQWKNFSADVKLTDDFFISNELIEDENGELTEVEREPGANAIGMVAFKITVKTPEYPRGRQFVVVANDITFKIGSFGPQEDEFFNKVTEYARKRGIPRIYLAANSGARIGMAEEIVPLFQVAWNDAANPDKGFQYLYLTSEGMETLKKFDKENSVLTERTVINGEERFVIKTIIGSEDGLGVECLRGSGLIAGATSRAYHDIFTITLVTCRSVGIGAYLVRLGQRAIQVEGQPIILTGAPAINKMLGREVYTSNLQLGGTQIMYNNGVSHLTAVDDLAGVEKIVEWMSYVPAKRNMPVPILETKDTWDRPVDFTPTNDETYDVRWMIEGRETESGFEYGLFDKGSFFETLSGWAKGVVVGRARLGGIPLGVIGVETRTVENLIPADPANPNSAETLIQEPGQVWHPNSAFKTAQAINDFNNGEQLPMMILANWRGFSGGQRDMFNEVLKYGSFIVDALVDYKQPIIIYIPPTGELRGGSWVVVDPTINADQMEMYADVNARAGVLEPQGMVGIKFRREKLLDTMNRLDDKYRELRSQLSNKSLAPEVHQQISKQLADRERELLPIYGQISLQFADLHDRSSRMVAKGVISKELEWTEARRFFFWRLRRRLNEEYLIKRLSHQVGEASRLEKIARIRSWYPASVDHEDDRQVATWIEENYKTLDDKLKGLKLESFAQDLAKKIRSDHDNAIDGLSEVIKMLSTDDKEKLLKTLK

SEQ ID NO: 98 - protein, 321 aa, Artificial Sequence
  Truncated geranyl pyrophosphate olivetolic acid geranyltransferase CsGOTt75
MAATTNQTEPPESDNHSVATKILNFGKACWKLQRPYTIIAFTSCACGLFGKELLHNTNLISWSLMFKAFFFLVAILCIASFTTTINQIYDLHIDRINKPDLPLASGEISVNTAWIMSIIVALFGLIITIKMKGGPLYIFGYCFGIFGGIVYSVPPFRWKQNPSTAFLLNFLAHIITNFTFYYASRAALGLPFELRPSFTFLLAFMKSMGSALALIKDASDVEGDTKFGISTLASKYGSRNLTLFCSGIVLLSYVAAILAGIIWPQAFNSNVMLLSHAILAFWLILQTRDFALTNYDPEAGRRFYEFMWKLYYAEYLVYVFI

SEQ ID NO: 99 - protein, 363 aa, Artificial Sequence
  Truncated geranyl pyrophosphate olivetolic acid geranyltransferase CsGOTt33
MSHPKTPIKYSYNNFPSKHCSTKSFHLQNKCSESLSIAKNSIRAATTNQTEPPESDNHSVATKILNFGKACWKLQRPYTIIAFTSCACGLFGKELLHNTNLISWSLMFKAFFFLVAILCIASFTTTINQIYDLHIDRINKPDLPLASGEISVNTAWIMSIIVALFGLIITIKMKGGPLYIFGYCFGIFGGIVYSVPPFRWKQNPSTAFLLNFLAHIITNFTFYYASRAALGLPFELRPSFTFLLAFMKSMGSALALIKDASDVEGDTKFGISTLASKYGSRNLTLFCSGIVLLSYVAAILAGIIWPQAFNSNVMLLSHAILAFWLILQTRDFALTNYDPEAGRRFYEFMWKLYYAEYLVYVFI

SEQ ID NO: 100 - protein, 323 aa, Artificial Sequence
  Truncated geranyl pyrophosphate olivetolic acid geranyltransferase CsPT4t
MSAGSDQIEGSPHHESDNSIATKILNFGHTCWKLQRPYVVKGMISIACGLFGRELFNNRHLFSWGLMWKAFFALVPILSFNFFAAIMNQIYDVDIDRINKPDLPLVSGEMSIETAWILSIIVALTGLIVTIKLKSAPLFVFIYIFGIFAGFAYSVPPIRWKQYPFTNFLITISSHVGLAFTSYSATTSALGLPFVWRPAFSFIIAFMTVMGMTIAFAKDISDIEGDAKYGVSTVATKLGARNMTFVVSGVLLLNYLVSISIGIIWPQVFKSNIMILSHAILAFCLIFQTRELALANYASAPSRQFFEFIWLLYYAEYFVYVFI

SEQ ID NO: 101 - protein, 323 aa, Artificial Sequence
  Truncated geranyl pyrophosphate olivetolic acid geranyltransferase CsPT7t
MSTDTANQTEPPESNTKYSVVTKILSFGHTCWKLQRPYTFIGVISCACGLFGRELFHNTNLLSWSLMLKAFSSLMVILSVNLCTNIINQITDLDIDRINKPDLPLASGEMSIETAWIMSIIVALTGLILTIKLNCGPLFISLYCVSILVGALYSVPPFRWKQNPNTAFSSYFMGLVIVNFTCYYASRAAFGLPFEMSPPFTFILAFVKSMGSALFLCKDVSDIEGDSKHGISTLATRYGAKNITFLCSGIVLLTYVSAILAAIIWPQAFKSNVMLLSHATLAFWLIFQTREFALTNYNPEAGRKFYEFMWKLHYAEYLVYVFI

SEQ ID NO: 102 - protein, 315 aa, Artificial Sequence
  Truncated geranyl pyrophosphate olivetolic acid geranyltransferase HlPT1Lt
MDRPPESGNLSALTNVKDFVSVCWEYVRPYTAKGVIICSSCLFGRELLENPNLFSWPLIFRALLGMLAILGSCFYTAGINQIFDMDIDRINKPDLPLVSGRISVESAWLLTLSPAIIGFILILKLNSGPLLTSLYCLAILSGTIYSVPPFRWKKNPITAFLCILMIHAGLNFSVYYASRAALGLAFVWSPSFSFITAFITFMTLTLASSKDLSDINGDRKFGVETFATKLGAKNITLLGTGLLLLNYVAAISTAIIWPKAFKSNIMLLSHAILAFSLFFQARELDRTNYTPEACKSFYEFIWILFSAEYVVYLFI

SEQ ID NO: 103 - protein, 329 aa, Artificial Sequence
  Truncated geranyl pyrophosphate olivetolic acid geranyltransferase HlPT2t
MGHLPRPNSLTAWSHQSEFPSTIVTKGSNFGHASWKFVRPIPFVAVSIICTSLFGAELLKNPNLFSWQLMFDAFQGLVVILLYHIYINGLNQIYDLESDRINKPDLPLAAEEMSVKSAWFLTIFSAVASLLLMIKLKCGLFLTCMYCCYLVIGAMYSVPPFRWKMNTFTSTLWNFSEIGIGINFLINYASRATLGLPFQWRPPFTFIIGFVSTLSIILSILKDVPDVEGDKKVGMSTLPVIFGARTIVLVGSGFFLLNYVAAIGVAIMWPQAFKGYIMIPAHAIFASALIFKTWLLDKANYAKEASDSYYHFLWFLMIAEYILYPFIST

SEQ ID NO: 104 - protein, 514 aa, Artificial Sequence
  Truncated tetrahydrocannabinolic acid synthase THCASt28
MNFLKCFSEYIPNNPANPKFIYTQHDQLYMSVLNSTIQNLRFTSDTTPKPLVIVTPSNVSHIQASILCSKKVGLQIRTRSGGHDAEGMSYISQVPFVVVDLRNMHSIKIDVHSQTAWVEAGATLGEVYYWINEKNENFSFPGGYCPTVGVGGHFSGGGYGALMRNYGLAADNIIDAHLVNVDGKVLDRKSMGEDLFWAIRGGGGENFGIIAAWKIKLVAVPSKSTIFSVKKNMEIHGLVKLFNKWQNIAYKYDKDLVLMTHFITKNITDNHGKNKTTVHGYFSSIFHGGVDSLVDLMNKSFPELGIKKTDCKEFSWIDTTIFYSGVVNFNTANFKKEILLDRSAGKKTAFSIKLDYVKKPIPETAMVKILEKLYEEDVGVGMYVLYPYGGIMEEISESAIPFPHRAGIMYELWYTASWEKQEDNEKHINWVRSVYNFTTPYVSQNPRLAYLNYRDLDLGKTNPESPNNYTQARIWGEKYFGKNFNRLVKVKTKADPNNFFRNEQSIPPLPPHHH

SEQ ID NO: 105 - protein, 517 aa, Artificial Sequence
  Truncated cannabidiolic acid synthase CBDASt28*
MNPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 106 - protein, 2051 aa, Artificial Sequence
  Mutated fatty acid synthase (FAS1, I306A, R1834K)
MDAYSTRPLTLSHGSLEHVLLVPTASFFIASQLQEQFNKILPEPTEGFAADDEPTTPAELVGKFLGYVSSLVEPSKVGQFDQVLNLCLTEFENCYLEGNDIHALAAKLLQENDTTLVKTKELIKNYITARIMAKRPFDKKSNSALFRAVGEGNAQLVAIFGGQGNTDDYFEELRDLYQTYHVLVGDLIKFSAETLSELIRTTLDAEKVFTQGLNILEWLENPSNTPDKDYLLSIPISCPLIGVIQLAHYVVTAKLLGFTPGELRSYLKGATGHSQGLVTAVAIAETDSWESFFVSVRKAITVLFFGGVRCYEAYPNTSLPPSILEDSLENNEGVPSPMLSISNLTQEQVQDYVNKTNSHLPAGKQVEISLVNGAKNLVVSGPPQSLYGLNLTLRKAKAPSGLDQSRIPFSERKLKFSNRFLPVASPFHSHLLVPASDLINKDLVKNNVSFNAKDIQIPVYDTFDGSDLRVLSGSISERIVDCIIRLPVKWETTTQFKATHILDFGPGGASGLGVLTHRNKDGTGVRVIVAGTLDINPDDDYGFKQEIFDVTSNGLKKNPNWLEEYHPKLIKNKSGKIFVETKFSKLIGRPPLLVPGMTPCTVSPDFVAATTNAGYTIELAGGGYFSAAGMTAAIDSVVSQIEKGSTFGINLIYVNPFMLQWGIPLIKELRSKGYPIQFLTIGAGVPSLEVASEYIETLGLKYLGLKPGSIDAISQVINIAKAHPNFPIALQWTGGRGGGHHSFEDAHTPMLQMYSKIRRHPNIMLIFGSGFGSADDTYPYLTGEWSTKFDYPPMPFDGFLFGSRVMIAKEVKTSPDAKKCIAACTGVPDDKWEQTYKKPTGGIVTVRSEMGEPIHKIATRGVMLWKEFDETIFNLPKNKLVPTLEAKRDYIISRLNADFQKPWFATVNGQARDLATMTYEEVAKRLVELMFIRSTNSWFDVTWRTFTGDFLRRVEERFTKSKTLSLIQSYSLLDKPDEAIEKVFNAYPAAREQFLNAQDIDHFLSMCQNPMQKPVPFVPVLDRRFEIFFKKDSLWQSEHLEAVVDQDVQRTCILHGPVAAQFTKVIDEPIKSIMDGIHDGHIKKLLHQYYGDDESKIPAVEYFGGESPVDVQSQVDSSSVSEDSAVFKATSSTDEESWFKALAGSEINWRHASFLCSFITQDKMFVSNPIRKVFKPSQGMVVEISNGNTSSKTVVTLSEPVQGELKPTVILKLLKENIIQMEMIENRTMDGKPVSLPLLYNFNPDNGFAPISEVMEDRNQRIKEMYWKLWIDEPFNLDFDPRDVIKGKDFEITAKEVYDFTHAVGNNCEDFVSRPDRTMLAPMDFAIVVGWRAIIKAIFPNTVDGDLLKLVHLSNGYKMIPGAKPLQVGDVVSTTAVIESVVNQPTGKIVDVVGTLSRNGKPVMEVTSSFFYRGNYTDFENTFQKTVEPVYQMHIKTSKDIAVLRSKEWFQLDDEDFDLLNKTLTFETETEVTFKNANIFSSVKCFGPIKVELPTKETVEIGIVDYEAGASHGNPVVDFLKRNGSTLEQKVNLENPIPIAVLDSYTPSTNEPYARVSGDLNPIHVSRHFASYANLPGTITHGMFSSASVRALIENWAADSVSSRVRGYTCQFVDMVLPNTALKTSIQHVGMINGRKLIKFETRNEDDVVVLTGEAEIEQPVTTFVFTGQGSQEQGMGMDLYKTSKAAQDVWNRADNHFKDTYGFSILDIVINNPVNLTIHFGGEKGKRIRENYSAMIFETIVDGKLKTEKIFKEINEHSTSYTFRSEKGLLSATQFTQPALTLMEKAAFEDLKSKGLIPADATFAGHSLGEYAALASLADVMSIESLVEVVFYFGMTMQVAVPRDELGRSNYGMIAINPGRVAASFSQEALQYVVERVGKRTGWLVEIVNYNVENQQYVAAGDLRALDTVTNVLNFIKLQKIDIIELQKSLSLEEVEGHLFEIIDEASKKSAVKPRPLKLERGFACIPLVGISVPFHSTYLMNGVKPFKSFLKKNIIKENVKVARLAGKYIPNLTAKPFQVTKEYFQDVYDLTGSEPIKEIIDNWEKYEQS

SEQ ID NO: 107 - protein, 1887 aa, Artificial Sequence
  Mutated fatty acid synthase (FAS2, G1250S)
MKPEVEQELAHILLTELLAYQFASPVRWIETQDVFLKDFNTERVVEIGPSPTLAGMAQRTLKNKYESYDAALSLHREILCYSKDAKEIYYTPDPSELAAKEEPAKEEAPAPTPAASAPAPAAAAPAPVAAAAPAAAAAEIADEPVKASLLLHVLVAHKLKKSLDSIPMSKTIKDLVGGKSTVQNEILGDLGKEFGTTPEKPEETPLEELAETFQDTFSGALGKQSSSLLSRLISSKMPGGFTITVARKYLQTRWGLPSGRQDGVLLVALSNEPAARLGSEADAKAFLDSMAQKYASIVGVDLSSAASASGAAGAGAAAGAAMIDAGALEEITKDHKVLARQQLQVLARYLKMDLDNGERKFLKEKDTVAELQAQLDYLNAELGEFFVNGVATSFSRKKARTFDSSWNWAKQSLLSLYFEIIHGVLKNVDREVVSEAINIMNRSNDALIKFMEYHISNTDETKGENYQLVKTLGEQLIENCKQVLDVDPVYKDVAKPTGPKTAIDKNGNITYSEEPREKVRKLSQYVQEMALGGPITKESQPTIEEDLTRVYKAISAQADKQDISSSTRVEFEKLYSDLMKFLESSKEIDPSQTTQLAGMDVEDALDKDSTKEVASLPNKSTISKTVSSTIPRETIPFLHLRKKTPAGDWKYDRQLSSLFLDGLEKAAFNGVTFKDKYVLITGAGKGSIGAEVLQGLLQGGAKVVVTTSRFSKQVTDYYQSIYAKYGAKGSTLIVVPFNQGSKQDVEALIEFIYDTEKNGGLGWDLDAIIPFAAIPEQGIELEHIDSKSEFAHRIMLTNILRMMGCVKKQKSARGIETRPAQVILPMSPNHGTFGGDGMYSESKLSLETLFNRWHSESWANQLTVCGAIIGWTRGTGLMSANNIIAEGIEKMGVRTFSQKEMAFNLLGLLTPEVVELCQKSPVMADLNGGLQFVPELKEFTAKLRKELVETSEVRKAVSIETALEHKVVNGNSADAAYAQVEIQPRANIQLDFPELKPYKQVKQIAPAELEGLLDLERVIVVTGFAEVGPWGSARTRWEMEAFGEFSLEGCVEMAWIMGFISYHNGNLKGRPYTGWVDSKTKEPVDDKDVKAKYETSILEHSGIRLIEPELFNGYNPEKKEMIQEVIVEEDLEPFEASKETAEQFKHQHGDKVDIFEIPETGEYSVKLLKGATLYIPKALRFDRLVAGQIPTGWNAKTYGISDDIISQVDPITLFVLVSVVEAFIASGITDPYEMYKYVHVSEVGNCSGSSMGGVSALRGMFKDRFKDEPVQNDILQESFINTMSAWVNMLLISSSGPIKTPVGACATSVESVDIGVETILSGKARICIVGGYDDFQEEGSFEFGNMKATSNTLEEFEHGRTPAEMSRPATTTRNGFMEAQGAGIQIIMQADLALKMGVPIYGIVAMAATATDKIGRSVPAPGKGILTTAREHHSSVKYASPNLNMKYRKRQLVTREAQIKDWVENELEALKLEAEEIPSEDQNEFLLERTREIHNEAESQLRAAQQQWGNDFYKRDPRIAPLRGALATYGLTIDDLGVASFHGTSTKANDKNESATINEMMKHLGRSEGNPVIGVFQKFLTGHPKGAAGAWMMNGALQILNSGIIPGNRNADNVDKILEQFEYVLYPSKTLKTDGVRAVSITSFGFGQKGGQAIVVHPDYLYGAITEDRYNEYVAKVSAREKSAYKFFHNGMIYNKLFVSKEHAPYTDELEEDVYLDPLARVSKDKKSGSLTFNSKNIQSKDSYINANTIETAKMIENMTKEKVSNGGVGVDVELITSINVENDTFIERNFTPQEIEYCSAQPSVQSSFAGTWSAKEAVFKSLGVKSLGGGAALKDIEIVRVNKNAPAVELHGNAKKAAEEAGVTDVKVSISHDDLQAVAVAVSTKK

SEQ ID NO: 108 - protein, 371 aa, Artificial Sequence
  MBPtag
MKIEEGKLVIWINGDKGYNGLAEVGKKFEKDTGIKVTVEHPDKLEEKFPQVAATGDGPDIIFWAHDRFGGYAQSGLLAEITPDKAFQDKLYPFTWDAVRYNGKLIAYPIAVEALSLIYNKDLLPNPPKTWEEIPALDKELKAKGKSALMFNLQEPYFTWPLIAADGGYAFKYENGKYDIKDVGVDNAGAKAGLTFLVDLIKNKHMNADTDYSIAEAAFNKGETAMTINGPWAWSNIDTSKVNYGVTVLPTFKGQPSKPFVGVLSAGINAASPNKELAKEFLENYLLTDEGLEAVNKDKPLGAVALKSYEEELAKDPRIAATMENAQKGEIMPNIPQMSAFWYAVRTAVINAASGRQTVDEALKDAQTRITK

SEQ ID NO: 109 - protein, 24 aa, Artificial Sequence
  ProA tag
MIFDGTTMSIAIGLLSTLGIGAEA

SEQ ID NO: 110 - protein, 398 aa, Cannibis sativa
MGLSLVCTFSFQTNYHTLLNPHNKNPKNSLLSYQHPKTPIIKSSYDNFPSKYCLTKNFHLLGLNSHNRISSQSRSIRAGSDQIEGSPHHESDNSIATKILNFGHTCWKLQRPYVVKGMISIACGLFGRELFNNRHLFSWGLMWKAFFALVPILSFNFFAAIMNQIYDVDIDRINKPDLPLVSGEMSIETAWILSIIVALTGLIVTIKLKSAPLFVFIYIFGIFAGFAYSVPPIRWKQYPFTNFLITISSHVGLAFTSYSATTSALGLPFVWRPAFSFIIAFMTVMGMTIAFAKDISDIEGDAKYGVSTVATKLGARNMTFVVSGVLLLNYLVSISIGIIWPQVFKSNIMILSHAILAFCLIFQTRELALANYASAPSRQFFEFIWLLYYAEYFVYVFI

SEQ ID NO: 111 - DNA, 1197 bp, Cannibis sativa
atgggtttatctttggtctgcaccttctcctttcaaactaactaccacactttattgaatccacataataagaatcctaagaactctttattgtcctaccaacacccaaagactcctattatcaagtcctcttacgataacttcccatctaagtactgtttgactaagaatttccatttgttgggtttgaattctcacaacagaatttcctcccaatcccgttctattagagccggttctgatcaaatcgaaggttcccctcatcatgagtccgataactccattgctactaaaattttaaatttcggtcatacttgttggaagttgcaacgtccttacgttgtcaagggtatgatctctattgcttgtggtttgttcggtagagaattgtttaacaacagacacttgttctcttggggtttgatgtggaaagctttcttcgctttggtcccaattttgtctttcaatttcttcgccgccatcatgaaccaaatctacgatgttgatatcgaccgtatcaacaagccagacttacctttagtttccggtgaaatgtccattgaaactgcttggatcttgtctatcattgttgccttgactggtttaattgttactattaagttgaagtccgctccattgtttgtcttcatctacatcttcggtatcttcgctggtttcgcttactccgtcccacctattagatggaaacaatatccttttaccaatttcttgatcactatttcctctcatgttggtttggctttcacttcttactctgccaccacttctgctttaggtttgcctttcgtttggcgtcctgccttctctttcattattgctttcatgactgtcatgggtatgactattgcctttgctaaagacatttctgatatcgaaggtgatgctaagtacggtgtctctaccgttgctaccaagttaggtgctagaaatatgacttttgttgtttctggtgtcttattgttgaactacttggtttctatctctattggtatcatttggccacaagttttcaagtctaacattatgatcttgtctcatgctattttggctttctgtttgatctttcaaactcgtgaattagccttagccaattatgcctctgccccatcccgtcaatttttcgaattcatctggttgttatactatgccgaatacttcgtttacgtcttcatttaa

SEQ ID NO: 112 - protein, 522 aa, Artificial Sequence
  Truncated acyl activating enzyme AAE (CsAAE3 truncation)
MEKSGYGRDGIYRSLRPPLHLPNNNNLSMVSFLFRNSSSYPQKPALIDSETNQILSFSHFKSTVIKVSHGFLNLGIKKNDWLIYAPNSIHFPVCFLGIIASGAIATTSNPLYTVSELSKQVKDSNPKLIITVPQLLEKVKGFNLPTILIGPDSEQESSSDKVMTFNDLVNLGGSSGSEFPIVDDFKQSDTAALLYSSGTTGMSKGWLTHKNFIASSLMVTMEQDLVGEMDNVFLCFLPMFHVFGLAIITYAQLQRGNTVISARFDLEKMLKDVEKYVTHLWWPPVILALSKNSMVKFNLSSIKYIGSGAAPLGKDLMEECSKWPYGIVAQGYGMTETCGIVSMEDIRGGKRNSGSAGMLASGVEAQIVSVDTLKPLPPNQLGEIWVKGPNMMQGYFNNPQATKLTIDKKGWVHTGDLGYFDEDGHLYWDRIKELIKYKGFQVAPAELEGLLVSHPEILDAWIPFPDAEAGEVPVAYWRSPNSSLTENDVKKFIAGQVASFKRLRKVTFINSVPKSASGKILR

SEQ ID NO: 113 - protein, 526 aa, Artificial Sequence
  Truncated 3-hydroxy-3-methyl-glutaryl-CoA reductase (tHMG1)
MSDQLVKTEVTKKSFTAPVQKASTPVLTNKTVISGSKVKSLSSAQSSSSGPSSSSEEDDSRDIESLDKKIRPLEELEALLSSGNTKQLKNKEVAALVIHGKLPLYALEKKLGDTTRAVAVRRKALSILAEAPVLASDRLPYKNYDYDRVFGACCENVIGYMPLPVGVIGPLVIDGTSYHIPMATTEGCLVASAMRGCKAINAGGGATTVLTKDGMTRGPVVRFPTLKRSGACKIWLDSEEGQNAIKKAFNSTSRFARLQHIQTCLAGDLLFMRFRTTTGDAMGMNMISKGVEYSLKQMVEEYGWEDMEVVSVSGNYCTDKKPAAINWIEGRGKSVVAEATIPGDVVRKVLKSDVSALVELNIAKNLVGSAMAGSVGGFNAHAANLVTAVFLALGQDPAQNVESSNCITLMKEVDGDLRISVSMPSIEVGTIGGGTVLEPQGAMLDLLGVRGPHATAPGTNARQLARIVACAVLAGELSLCAALAAGHLVQSHMTHNRKPAEPTKPNNLDATDINRLKDGSVTCIKS

SEQ ID NO: 114 - DNA, 1581 bp, Artificial Sequence
  Truncated 3-hydroxy-3-methyl-glutaryl-CoA reductase (tHMG1)
atgtccgatcaattagtcaagaccgaagtcaccaagaagtccttcaccgccccagttcaaaaagcctccactccagtcttaactaacaagaccgttatttctggttccaaggttaagtctttatcctccgctcaatcctcctcttccggtccatcttcttcttctgaagaagatgattcccgtgacattgagtccttggataagaaaatcagacctttggaagaattagaagctttgttatcctctggtaatactaagcaattgaaaaacaaggaagttgctgctttggttattcacggtaaattacctttgtacgctttagagaagaagttaggtgacactacccgtgctgtcgccgttagaagaaaagctttgtctattttagctgaggcccctgttttggcttctgacagattaccatacaagaattacgattacgatagagttttcggtgcctgttgtgagaacgttatcggttatatgccattaccagtcggtgttatcggtccattggttattgacggtacctcttaccacatcccaatggctactactgaaggttgtttagtcgcctccgccatgagaggttgtaaggctatcaatgctggtggtggtgctactaccgtcttgactaaggatggtatgactagaggtccagttgtccgttttccaactttgaaaagatctggtgcttgtaagatttggttggattctgaagaaggtcaaaatgccattaagaaggctttcaattccacctctagatttgccagattacaacatattcaaacctgtttagccggtgatttgttgttcatgagattcagaactactactggtgatgctatgggtatgaacatgatctctaagggtgtcgaatattctttaaaacaaatggttgaagagtatggttgggaagacatggaggtcgtctctgtctctggtaactactgtactgataagaaaccagctgctatcaactggatcgaaggtcgtggtaagtctgttgttgccgaagctactattccaggtgatgttgttagaaaggttttaaaatccgatgtctctgccttggttgagttgaacattgctaaaaacttggttggttctgctatggctggttctgtcggtggttttaatgcccatgccgccaacttagtcaccgccgttttcttagctttgggtcaagatccagctcaaaatgtcgaatcctccaactgtatcactttgatgaaagaggtcgacggtgacttgcgtatctctgtttccatgccatctatcgaagttggtactatcggtggtggtactgttttggagccacaaggtgctatgttggacttattgggtgttagaggtccacacgccactgctcctggtaccaacgccagacaattagctagaatcgttgcctgtgccgtcttagctggtgagttgtctttatgtgctgccttagctgctggtcacttggtccaatcccacatgactcataacagaaagccagctgaacctaccaagcctaacaacttggatgccaccgatattaatcgtttaaaagatggttctgtcacttgcattaagtcctaa

SEQ ID NO: 115 - protein, 461 aa, Saccharomyces sp.
MTELKKQKTAEQKTRPQNVGIKGIQIYIPTQCVNQSELEKFDGVSQGKYTIGLGQTNMSFVNDREDIYSMSLTVLSKLIKSYNIDTNKIGRLEVGTETLIDKSKSVKSVLMQLFGENTDVEGIDTLNACYGGTNALFNSLNWIESNAWDGRDAIVVCGDIAIYDKGAARPTGGAGTVAMWIGPDAPIVFDSVRASYMEHAYDFYKPDFTSEYPYVDGHFSLTCYVKALDQVYKSYSKKAISKGLVSDPAGSDALNVLKYFDYNVFHVPTCKLVTKSYGRLLYNDFRANPQLFPEVDAELATRDYDESLTDKNIEKTFVNVAKPFHKERVAQSLIVPTNTGNMYTASVYAAFASLLNYVGSDDLQGKRVGLFSYGSGLAASLYSCKIVGDVQHIIKELDITNKLAKRITETPKDYEAAIELRENAHLKKNFKPQGSIEHLQSGVYYLTNIDDKFRRSYDVKK

SEQ ID NO: 116 - DNA, 1386 bp, Saccharomyces sp.
atgaccgaattgaagaagcaaaagactgctgaacaaaaaacccgtccacaaaatgttggtatcaagggtattcaaatctacattccaactcaatgcgtcaaccaatctgaattggaaaaatttgatggtgtttctcaaggtaaatacactattggtttgggtcaaactaatatgtccttcgttaacgacagagaagatatttactccatgtccttgaccgtcttgtccaaattgattaagtcttataatattgacaccaacaagatcggtagattggaagttggtactgaaactttgattgataagtctaagtctgttaagtctgttttaatgcaattgttcggtgaaaatactgacgttgaaggtattgacactttgaacgcttgttacggtggtactaatgctttatttaactctttgaactggattgaatccaacgcttgggacggtagagatgccattgtcgtttgtggtgacattgctatctatgacaagggtgccgctcgtccaactggtggtgctggtaccgttgctatgtggatcggtcctgacgccccaatcgtttttgattctgttcgtgcttcttacatggagcatgcttacgacttttataagccagactttacctccgaatatccatacgtcgatggtcatttctctttgacctgctacgttaaagccttagatcaagtctacaagtcttactccaagaaggccatttccaagggtttagtctccgatccagctggttccgatgctttaaacgttttaaagtacttcgattacaacgtttttcatgtccctacttgtaaattggttaccaaatcttacggtagattattgtacaacgatttcagagctaatccacaattatttccagaagtcgatgctgagttggctactagagattacgacgaatccttgaccgacaaaaatattgaaaagacttttgttaacgttgctaagccatttcacaaagagagagttgcccaatctttgattgtcccaactaatactggtaatatgtatactgcttctgtttacgctgcctttgcttctttgttgaactatgtcggttctgacgacttacaaggtaagcgtgtcggtttgttctcctacggttccggtttggctgcctctttgtattcttgtaagattgtcggtgatgttcaacacatcatcaaggaattggatatcaccaataaattggccaagagaatcactgaaactcctaaagactatgaagctgctatcgaattgagagaaaatgctcatttaaagaaaaactttaaaccacaaggttctattgaacacttgcaatccggtgtttactacttaactaacatcgatgacaagttccgtagatcctacgacgtcaagaagtaa

SEQ ID NO: 117 - protein, 568 aa, Zymomonas mobilis
MSYTVGTYLAERLVQIGLKHHFAVAGDYNLVLLDNLLLNKNMEQVYCCNELNCGFSAEGYARAKGAAAAVVTYSVGALSAFDAIGGAYAENLPVILISGAPNNNDHAAGHVLHHALGKTDYHYQLEMAKNITAAAEAIYTPEEAPAKIDHVIKTALREKKPVYLEIACNIASMPCAAPGPASALFNDEASDEASLNAAVEETLKFIANRDKVAVLVGSKLRAAGAEEAAVKFADALGGAVATMAAAKSFFPEENPHYIGTSWGEVSYPGVEKTMKEADAVIALAPVFNDYSTTGWTDIPDPKKLVLAEPRSVVVNGIRFPSVHLKDYLTRLAQKVSKKTGALDFFKSLNAGELKKAAPADPSAPLVNAEIARQVEALLTPNTTVIAETGDSWFNAQRMKLPNGARVEYEMQWGHIGWSVPAAFGYAVGAPERRNILMVGDGSFQLTAQEVAQMVRLKLPVIIFLINNYGYTIEVMIHDGPYNNIKNWDYAGLMEVFNGNGGYDSGAGKGLKAKTGGELAEAIKVALANTDGPTLIECFIGREDCTEELVKWGKRVAAANSRKPVNKLL

SEQ ID NO: 118 - DNA, 1707 bp, Zymomonas mobilis
atgtcctacaccgttggtacctacttagctgagcgtttggtccaaatcggtttgaagcaccatttcgccgttgctggtgattacaacttggtcttgttagataatttattattgaacaagaacatggaacaagtctactgctgtaatgaattgaactgtggtttctctgctgaaggttatgctagagctaaaggtgccgctgccgctgttgtcacttactctgttggtgctttgtctgccttcgacgctattggtggtgcttacgccgagaatttacctgttattttaatttctggtgcccctaacaataacgatcatgctgctggtcatgttttacaccacgctttgggtaaaactgactaccattatcaattagagatggccaaaaacatcaccgccgctgccgaggccatttacactccagaagaagccccagccaaaattgatcacgtcatcaaaaccgccttgagagagaaaaaacctgtttacttggaaatcgcctgtaatatcgcctctatgccttgcgccgctcctggtcctgcttccgccttattcaacgatgaggcttctgatgaagcttccttaaacgctgctgttgaggagactttaaagttcatcgctaatagagataaggtcgctgttttagtcggttctaagttgcgtgctgccggtgccgaggaagctgctgttaaattcgccgatgctttaggtggtgctgtcgccaccatggccgccgccaaatcctttttccctgaagaaaacccacactacatcggtacttcttggggtgaagtctcttacccaggtgtcgaaaagactatgaaggaagccgatgccgtcatcgccttggccccagtttttaatgattattccaccactggttggactgatatcccagatcctaaaaagttagttttagccgagcctagatccgttgttgttaacggtattagattcccttccgttcacttgaaggattacttaactagattggctcaaaaggtttccaagaagaccggtgctttggactttttcaaatctttgaacgccggtgagttaaagaaggccgcccctgctgacccatctgctccattggttaacgctgagattgctagacaagtcgaagctttattgaccccaaacactaccgttatcgccgaaactggtgactcttggtttaatgctcaaagaatgaagttaccaaatggtgccagagttgagtacgaaatgcaatggggtcatatcggttggtctgtcccagctgcttttggttatgctgttggtgcccctgagagaagaaacatcttgatggttggtgacggttccttccaattgactgctcaagaagtcgctcaaatggttagattaaaattaccagtcatcatcttcttgatcaataactacggttacactatcgaagtcatgattcacgatggtccttacaataatattaagaactgggactatgctggtttgatggaagtctttaatggtaacggtggttacgattccggtgctggtaagggtttaaaggctaagactggtggtgaattagctgaagccattaaggttgccttggctaacaccgacggtcctactttaatcgaatgtttcattggtagagaggattgtaccgaagagttagttaagtggggtaagagagttgccgctgctaattcccgtaagcctgtcaataaattgttataa

SEQ ID NO: 119 - DNA, 1575 bp, Artificial Sequence
  Truncated 3-hydroxy-3-methyl-glutaryl-CoA reductase (tHMG1)
atgcaattggtgaagactgaagtcaccaagaagtcttttactgctcctgtacaaaaggcttctacaccagttttaaccaataaaacagtcatttctggatcgaaagtcaaaagtttatcatctgcgcaatcgagctcatcaggaccttcatcatctagtgaggaagatgattcccgcgatattgaaagcttggataagaaaatacgtcctttagaagaattagaagcattattaagtagtggaaatacaaaacaattgaagaacaaagaggtcgctgccttggttattcacggtaagttacctttgtacgctttggagaaaaaattaggtgatactacgagagcggttgcggtacgtaggaaggctctttcaattttggcagaagctcctgtattagcatctgatcgtttaccatataaaaattatgactacgaccgcgtatttggcgcttgttgtgaaaatgttataggttacatgcctttgcccgttggtgttataggccccttggttatcgatggtacatcttatcatataccaatggcaactacagagggttgtttggtagcttctgccatgcgtggctgtaaggcaatcaatgctggcggtggtgcaacaactgttttaactaaggatggtatgacaagaggcccagtagtccgtttcccaactttgaaaagatctggtgcctgtaagatatggttagactcagaagagggacaaaacgcaattaaaaaagcttttaactctacatcaagatttgcacgtctgcaacatattcaaacttgtctagcaggagatttactcttcatgagatttagaacaactactggtgacgcaatgggtatgaatatgatttctaagggtgtcgaatactcattaaagcaaatggtagaagagtatggctgggaagatatggaggttgtctccgtttctggtaactactgtaccgacaaaaaaccagctgccatcaactggatcgaaggtcgtggtaagagtgtcgtcgcagaagctactattcctggtgatgttgtcagaaaagtgttaaaaagtgatgtttccgcattggttgagttgaacattgctaagaatttggttggatctgcaatggctgggtctgttggtggatttaacgcacatgcagctaatttagtgacagctgttttcttggcattaggacaagatcctgcacaaaatgtcgaaagttccaactgtataacattgatgaaagaagtggacggtgatttgagaatttccgtatccatgccatccatcgaagtaggtaccatcggtggtggtactgttctagaaccacaaggtgccatgttggacttattaggtgtaagaggcccacatgctaccgctcctggtaccaacgcacgtcaattagcaagaatagttgcctgtgccgtcttggcaggtgaattatccttatgtgctgccctagcagccggccatttggttcaaagtcatatgacccacaacaggaaacctgctgaaccaacaaaacctaacaatttggacgccactgatataaatcgtttgaaagatgggtccgtcacctgcattaaatcctaa

SEQ ID NO: 120 - DNA, 1387 bp, Saccharomyces sp.
atgactgaactaaaaaaacaaaagaccgctgaacaaaaaaccagacctcaaaatgtcggtattaaaggtatccaaatttacatcccaactcaatgtgtcaaccaatctgagctagagaaatttgatggcgtttctcaaggtaaatacacaattggtctgggccaaaccaacatgtcttttgtcaatgacagagaagatatctactcgatgtccctaactgttttgtctaagttgatcaagagttacaacatcgacaccaacaaaattggtagattagaagtcggtactgaaactctgattgacaagtccaagtctgtcaagtctgtcttgatgcaattgtttggtgaaaacactgacgtcgaaggtattgacacgcttaatgcctgttacggtggtaccaacgcgttgttcaactctttgaactggattgaatctaacgcatgggatggtagagacgccattgtagtttgcggtgatattgccatctacgataagggtgccgcaagaccaaccggtggtgccggtactgttgctatgtggatcggtcctgatgctccaattgtatttgactctgtaagagcttcttacatggaacacgcctacgatttttacaagccagatttcaccagcgaatatccttacgtcgatggtcatttttcattaacttgttacgtcaaggctcttgatcaagtttacaagagttattccaagaaggctatttctaaagggttggttagcgatcccgctggttcggatgctttgaacgttttgaaatatttcgactacaacgttttccatgttccaacctgtaaattggtcacaaaatcatacggtagattactatataacgatttcagagccaatcctcaattgttcccagaagttgacgccgaattagctactcgcgattatgacgaatctttaaccgataagaacattgaaaaaacttttgttaatgttgctaagccattccacaaagagagagttgcccaatctttgattgttccaacaaacacaggtaacatgtacaccgcatctgtttatgccgcctttgcatctctattaaactatgttggatctgacgacttacaaggcaagcgtgttggtttattttcttacggttccggtttagctgcatctctatattcttgcaaaattgttggtgacgtccaacatattatcaaggaattagatattactaacaaattagccaagagaatcaccgaaactccaaaggattacgaagctgccatcgaattgagagaaaatgcccatttgaagaagaacttcaaacctcaaggttccattgagcatttgcaaagtggtgtttactacttgaccaacatcgatgacaaatttagaagatcttacgatgttaaaaaataat

SEQ ID NO: 121 - protein, 420 aa, Catharanthus sp.
MLFSRGLYRIARTSLNRSRLLYPLQSQSPELLQSFQFRSPIGSSQKVSGFRVIYSCVSSALANVGQQVQRQSNSVAEEPLDPFSLVADELSILANRLRSMVVAEVPKLASAAEYFFKLGVEGKRFRPTVLLLMATAIDAPISRTPPDTSLDTLSTELRLRQQSIAEITEMIHVASLLHDDVLDDAETRRGIGSLNFVMGNKLAVLAGDFLLSRACVALASLKNTEVVSLLATVVEHLVTGETMQMTTTSDQRCSMEYYMQKTYYKTASLISNSCKAIALLAGQTSEVAMLAYEYGKNLGLAFQLIDDVLDFTGTSASLGKGSLSDIRHGIVTAPILFAIEEFPELRAVVDEGFENPYNVDLALHYLGKSRGIQRTRELAIKHANLASDAIDSLPVTDDEHVLRSRRALVELTQRVITRRK

SEQ ID NO: 122 - DNA, 1263 bp, Catharanthus sp.
atgttattctctcgtggtttatacagaatcgccagaacttctttgaacagatcccgtttgttgtaccctttacaatctcaatctcctgaattgttacaatccttccaattcagatctccaatcggttcctctcaaaaggtttccggtttcagagttatctactcctgcgtttcctctgctttagctaacgttggtcaacaagtccaaagacaatctaattccgttgctgaagaacctttggacccattctccttggttgccgatgaattatccattttagctaacagattgcgttctatggtcgtcgctgaagttccaaagttagcctccgccgccgaatatttcttcaagttgggtgtcgagggtaaaagattcagaccaactgttttgttgttaatggccaccgccattgatgccccaatctctagaaccccacctgacacctccttagatactttatccaccgaattgcgtttgagacaacaatctatcgccgaaattactgaaatgattcatgtcgcttccttgttgcacgatgatgttttggatgatgctgaaactagaagaggtattggttctttaaattttgtcatgggtaacaaattggctgttttggccggtgacttcttattatctagagcttgtgttgccttagcttctttgaaaaacactgaagtcgtctccttgttagccactgtcgttgaacacttagttactggtgagactatgcaaatgactaccacctccgatcaaagatgttctatggaatactacatgcaaaagacctattacaagactgcctctttgatttctaactcctgtaaagccattgccttgttagctggtcaaacttctgaagttgccatgttggcttacgaatacggtaaaaacttgggtttggctttccaattgattgatgatgttttggatttcactggtacttctgcttccttaggtaaaggttctttgtctgatattcgtcacggtatcgttaccgccccaatcttgttcgctattgaagaattcccagagttaagagctgttgttgacgaaggtttcgaaaacccttacaatgttgacttagccttgcactacttgggtaaatctagaggtattcaacgtaccagagaattagccattaaacatgctaacttagcctctgacgccattgactctttaccagtcactgatgatgagcacgtcttacgttccagacgtgccttagttgaattgactcaaagagttattactagaagaaagtaa

SEQ ID NO: 123 - protein, 421 aa, Mangifera indica
MLFSYGLSRISINPRASLLTCRWLLSHLTGSLSPSTSSHTISDSVHKVWGCREAYTWSVPALHGFRHQIHHQSSSLIEDQLDPFSLVADELSLVANRLRSMVVTEVPKLASAAEYFFKMGVEGKRFRPAVLLLMATALNVHVLEPLPEGAGDALMTELRTRQQCIAEITEMIHVASLLHDDVLDDADTRRGIGSLNLVMGNKLAVLAGDFLLSRACVALASLKNTEVVSLLATVVEHLVTGETMQMTTSSDQRCSMEYYMQKTYYKTASLISNSCKAIALLAGQSAEVAMLAFEFGKNLGLAYQLIDDVLDFTGTSASLGKGSLSDIRHGIVTAPILFAMEEFPQLRAVIDQGFENPSNVDVALEYLGKSRGIQRTRELATNHANLAAAAIDALPKTDNEEVRKSRRALLDLTQRVITRNK

SEQ ID NO: 124 - DNA, 1266 bp, Mangifera indica
atgttattctcttatggtttatctcgtatttctattaaccctcgtgcctctttattgacttgtagatggttattatcccatttgactggttctttatctccttccacttcttcccatactatttctgactccgtccataaagtctggggttgcagagaagcctatacttggtctgtcccagctttacatggttttagacatcaaatccaccatcaatcctcttccttgattgaagatcaattagacccattctccttggtcgccgatgagttgtccttggttgctaaccgtttaagatctatggttgtcactgaagtccctaaattagcctctgccgccgaatactttttcaagatgggtgtcgaaggtaagcgtttcagaccagctgtcttgttgttaatggccactgccttaaacgttcatgttttggaacctttgcctgaaggtgctggtgacgctttaatgaccgagttgagaacccgtcaacaatgcattgctgaaatcactgagatgatccacgtcgcctctttattgcatgacgatgttttagacgacgctgatactagaagaggtattggttctttgaacttggttatgggtaacaaattggccgttttggccggtgatttcttgttatcccgtgcttgcgttgctttagcttctttgaagaacactgaagttgtttctttgttggccaccgtcgttgaacacttagttactggtgagactatgcaaatgaccacctcttctgaccaaagatgttccatggaatattacatgcaaaaaacttattacaaaaccgcctccttgatttctaactcctgtaaagccatcgccttattagctggtcaatctgctgaagttgccatgttagccttcgagtttggtaagaacttgggtttagcttaccaattgatcgatgatgtcttggattttaccggtacctctgcttctttgggtaagggttccttgtccgacattagacacggtattgttaccgccccaatcttattcgctatggaagagtttccacaattgagagctgttatcgaccaaggtttcgagaacccatctaacgttgacgtcgccttagagtatttaggtaaatctagaggtatccaacgtacccgtgaattagctactaaccatgctaacttagccgccgccgccatcgatgccttgcctaaaaccgataatgaagaagtccgtaagtccagacgtgctttattagatttgactcaaagagtcatcaccagaaacaaatag

SEQ ID NO: 125 - protein, 328 aa, Mangifera indica
MPFVVPRRNRSLSVSAVLTKEETLREEEEDPKPVFDFKSYMLQKGNSVNQALDAVVSIREPKKIHEAMRYSLLAGGKRVRPVLCIAACELVGGNESMAMPAACAVEMIHTMSLIHDDLPCMDNDDLRRGKPTNHKVFGEDVAVLAGDALLAFSFENMAVSTVGVLPSRVVKAVGELAKSIGIEGLVAGQVVDINSEGLKEVGLDHLEFIHQHKTAALLEGSVVLGAILGGGSDDEVEKLRTFARCIGLLFQVVDDILDVTKSSRELGKTAGKDLVADKVTYPKLLGIEKSRELADKLNKDAQQQLSGFDQEKAAPLIALSNYIAYRQN

SEQ ID NO: 126 - DNA, 987 bp, Mangifera indica
atgccattcgttgttcctagaagaaaccgttctttgtccgtttccgccgttttgaccaaggaagaaactttaagagaggaagaagaagatccaaagccagttttcgacttcaaatcttacatgttacaaaagggtaattctgttaatcaagctttggatgctgtcgtttccattagagaacctaagaaaatccatgaggctatgcgttactctttgttggctggtggtaagagagttcgtcctgttttgtgtattgccgcctgtgaattggtcggtggtaacgaatctatggctatgccagccgcctgtgctgtcgaaatgatccacactatgtccttgattcacgatgatttgccatgtatggataatgacgatttgcgtcgtggtaaacctaccaaccataaagttttcggtgaagacgtcgccgttttggctggtgacgctttattagctttttccttcgagaacatggccgtttccactgttggtgtcttaccatccagagttgtcaaggctgttggtgaattggccaagtctatcggtattgaaggtttggttgccggtcaagtcgtcgatattaattctgagggtttaaaagaggtcggtttagatcacttagaatttatccatcaacacaaaaccgctgctttgttggagggttctgttgttttgggtgctattttaggtggtggttctgatgatgaagtcgaaaagttgcgtacctttgctagatgtatcggtttgttgtttcaagttgttgacgatattttggatgtcactaagtcttccagagaattgggtaagactgccggtaaagatttggttgctgataaagttacttatccaaagttgttaggtattgaaaagtctcgtgaattggccgataagttaaacaaggatgctcaacaacaattatccggttttgatcaagagaaggctgcccctttaatcgctttgtccaattacatcgcctacagacaaaactag

SEQ ID NO: 127 - protein, 321 aa, Artificial Sequence
  Truncated geranylgeranyl pyrophosphate synthase Cs2_GPPS_NTrunc
MVIAEVPKLASAAEYFFKMGVEGKRFRPTVLLLMATALNVRVPEPLHDGVEDASATELRTRQQCIAEITEMIHVASLLHDDVLDDADTRRGIGSLNFVMGNKLAVLAGDFLLSRACVALASLKNTEVVTLLATVVEHLVTGETMQMTTSSDQRCSMDYYMQKTYYKTASLISNSCKAIALLAGQTAEVAILAFDYGKNLGLAYQLIDDVLDFTGTSASLGKGSLSDIRHGIITAPILFAMEEFPQLRTVVEQGFEDSSNVDIALEYLGKSRGIQKTRELAVKHANLAAAAIDSLPENNDEDVTKSRRALLDLTHRVITRNK

SEQ ID NO: 128 - DNA, 966 bp, Artificial Sequence
  Truncated geranylgeranyl pyrophosphate synthase Cs2_GPPS_NTrunc
atggtcattgctgaagttcctaaattagcctctgccgccgaatacttcttcaagatgggtgtcgagggtaagagatttcgtcctaccgttttgttgttaatggccaccgccttaaacgtcagagtccctgaaccattacatgatggtgttgaagatgcctctgccaccgagttgagaactagacaacaatgtattgctgaaatcaccgagatgattcacgttgcctctttgttgcacgatgatgttttggatgatgctgatacccgtcgtggtatcggttctttgaactttgtcatgggtaacaagttggctgtcttggctggtgatttcttattgtctcgtgcctgcgttgccttagcctctttaaaaaataccgaagttgttactttattggccactgttgttgagcacttggttactggtgaaactatgcaaatgaccacctcttccgaccaacgttgttccatggactattacatgcaaaagacctactacaagaccgcttctttgatttccaattcttgtaaagccattgccttattagctggtcaaactgctgaagttgccatcttggccttcgactacggtaaaaacttgggtttagcttaccaattgattgatgacgttttagattttactggtacttctgcttctttgggtaaaggttctttatccgatattcgtcatggtatcattaccgctccaatcttattcgctatggaagaatttcctcaattgcgtactgtcgttgaacaaggtttcgaagactcctccaacgttgacattgccttagaatacttgggtaagtctcgtggtattcaaaagacccgtgaattagccgttaaacatgccaacttagccgccgccgccatcgattccttgcctgaaaacaacgatgaggatgtcaccaagtcccgtcgtgctttgttagatttaactcacagagttattacccgtaacaagtaa

SEQ ID NO: 129 - protein, 416 aa, Quercus sp.
MLFSRISRIRRPGSNGFRWFLSHKTHLQFLNPPAYSYSSTHKVLGCREIFSWGLPALHGFRHNIHHQSSSIVEEQNDPFSLVADELSMVANRLRSMVVTEVPKLASAAEYFFKMGVEGKRFRPTVLLLMATAMNISILEPSLRGPGDALTTELRARQQRIAEITEMIHVASLLHDDVLDDADTRRGIGSLNFVMGNKLAVLAGDFLLSRACVALASLKNTEVVSLLAKVVEHLVTGETMQMTTTCEQRCSMEYYMQKTYYKTASLISNSCKAIALLGGQTSEVAMLAYEYGKNLGLAYQLIDDVLDFTGTSASLGKGSLSDIRHGIITAPILFAMEEFPQLREVVDRGFDDPANVDVALDYLGKSRGIQRARELAKKHANIAAEAIDSLPESNDEDVRKSRRALLDLTERVITRTK

SEQ ID NO: 130 - DNA, 1251 bp, Quercus sp.
atgttgttctctcgtatttctcgtatccgtagaccaggttctaatggtttcagatggttcttgtcccataagactcatttacaattcttgaaccctccagcttattcctactcttccactcataaggtcttgggttgtagagaaattttttcctggggtttacctgccttacatggtttcagacacaacattcaccaccaatcttcctctattgttgaagaacaaaatgaccctttctctttggtcgctgatgagttgtccatggttgctaacagattgcgttctatggttgttactgaagttcctaaattagcctccgccgctgaatacttttttaaaatgggtgttgaaggtaagagattcagaccaactgttttattgttgatggctaccgccatgaacatttccatcttagaaccatctttgagaggtccaggtgacgctttgaccactgaattgagagccagacaacaaagaattgctgaaattaccgagatgatccacgttgcttccttgttgcacgatgacgttttggatgacgctgatactagaagaggtattggttccttaaactttgtcatgggtaataaattagctgttttggctggtgattttttgttatctcgtgcctgtgttgctttagcttctttgaagaacaccgaagttgtctccttgttagccaaggtcgtcgaacacttggttactggtgaaactatgcaaatgaccactacttgtgaacaaagatgttccatggaatactacatgcaaaagacttactataagaccgcttctttaatttccaactcctgtaaagccattgctttattaggtggtcaaacttctgaggtcgctatgttagcctacgaatatggtaaaaacttgggtttagcttaccaattgattgatgatgtcttggatttcactggtacttctgcttccttgggtaagggttccttgtctgatattagacatggtatcattactgctccaattttgtttgctatggaagaattcccacaattacgtgaagttgtcgatagaggtttcgacgatcctgccaacgtcgatgttgccttggactacttgggtaagtctagaggtatccaaagagccagagagttagctaaaaaacacgctaacattgctgccgaagccatcgactctttgccagaatccaacgacgaggacgtcagaaagtcccgtcgtgctttgttggacttgaccgaaagagtcattactcgtactaagtaa

SEQ ID NO: 131 - protein, 427 aa, Artificial Sequence
  Truncated geranylgeranyl pyrophosphate synthase Pa_GPPS_Ntrunc
MYTRCILRDKYSRFNLRRKFFTSAKSINALNGLPDSGNPRGESNGISQFEIQQVFRCKEYIWIDRHKFHDVGFQAHHKGSITDEEQVDPFSLVADELSILANRLRSMILTEIPKLGTAAEYFFKLGVEGKRFRPMVLLLMASSLTIGIPEVAADCLRKGLDEEQRLRQQRIAEITEMIHVASLLHDDVLDDADTRRGVGSLNFVMGNKLAVLAGDFLLSRASVALASLKNTEVVELLSKVLEHLVTGEIMQMTNTNEQRCSMEYYMQKTFYKTASLMANSCKAIALIAGQPAEVCMLAYDYGRNLGLAYQLLDDVLDFTGTTASLGKGSLSDIRQGIVTAPILFALEEFPQLHDVINRKFKKPGDIDLALEFLGKSDGIRKAKQLAAQHAGLAAFSVESFPPSESEYVKLCRKALIDLSEKVITRTR

SEQ ID NO: 132 - DNA, 1284 bp, Artificial Sequence
  Truncated geranylgeranyl pyrophosphate synthase Pa_GPPS_N_trunc
atgtatacccgttgcattttaagagacaagtattctcgtttcaacttgagacgtaaattcttcacttccgctaaatccatcaatgccttgaatggtttacctgactctggtaaccctagaggtgaatctaacggtatctcccaattcgaaattcaacaagttttccgttgtaaagaatacatttggatcgatcgtcacaagttccacgatgttggttttcaagctcatcacaagggttccatcactgacgaggaacaagttgaccctttttctttagtcgctgatgaattgtccatcttagctaatcgtttaagatccatgatcttaaccgagattccaaagttaggtaccgctgccgaatactttttcaagttgggtgtcgaaggtaagagatttagaccaatggttttgttgttgatggcctcctctttaactattggtatccctgaagttgccgctgattgtttgcgtaagggtttggacgaagaacaaagattacgtcaacaacgtatcgctgaaattactgaaatgattcatgtcgcctctttgttgcacgatgatgttttggatgacgccgatactagacgtggtgttggttccttgaactttgttatgggtaacaagttggctgttttagccggtgatttcttgttatctagagcttctgttgccttagcttctttaaagaacactgaggttgttgagttattgtctaaggttttggagcacttagtcactggtgagatcatgcaaatgactaacactaatgaacaaagatgttctatggaatattacatgcaaaagactttctacaagaccgcctctttgatggctaattcttgtaaagccattgccttgatcgctggtcaacctgccgaagtctgcatgttggcctacgactacggtagaaacttgggtttagcttatcaattattggatgacgttttggatttcactggtaccactgcttctttaggtaagggttccttatccgacatcagacaaggtattgttactgcccctattttattcgctttggaagaattccctcaattacacgacgtcatcaaccgtaagttcaaaaaaccaggtgacatcgatttggccttggaatttttgggtaagtctgatggtatccgtaaagccaaacaattggctgctcaacatgctggtttagctgccttttctgtcgaatcctttccaccatctgaatccgaatacgttaagttatgtagaaaggccttgatcgatttgtctgaaaaggtcattactcgtaccagataa

SEQ ID NO: 133 - protein, 381 aa, Abies grandis
MAYSAMATMGYNGMAASCHTLHPTSPLKPFHGASTSLEAFNGEHMGLLRGYSKRKLSSYKNPASRSSNATVAQLLNPPQKGKKAVEFDFNKYMDSKAMTVNEALNKAIPLRYPQKIYESMRYSLLAGGKRVRPVLCIAACELVGGTEELAIPTACAIEMIHTMSLMHDDLPCIDNDDLRRGKPTNHKIFGEDTAVTAGNALHSYAFEHIAVSTSKTVGADRILRMVSELGRATGSEGVMGGQMVDIASEGDPSIDLQTLEWIHIHKTAMLLECSVVCGAIIGGASEIVIERARRYARCVGLLFQVVDDILDVTKSSDELGKTAGKDLISDKATYPKLMGLEKAKEFSDELLNRAKGELSCFDPVKAAPLLGLADYVAFRQN

SEQ ID NO: 134 - DNA, 1146 bp, Abies grandis
atggcttattctgctatggctactatgggttacaacggtatggctgcttcttgtcacactttacacccaacttctccattgaaaccttttcacggtgcttctacttccttggaagccttcaatggtgaacacatgggtttgttaagaggttattctaagcgtaagttgtcctcttacaaaaatccagcttctcgttcctccaatgctaccgtcgctcaattattgaacccaccacaaaagggtaagaaggctgttgaatttgacttcaataagtatatggattctaaggctatgaccgtcaacgaggctttgaataaagccatcccattgcgttacccacaaaagatctacgaatctatgagatattctttgttagctggtggtaagagagtccgtccagttttgtgtatcgccgcttgtgaattagtcggtggtactgaggagttagctattccaaccgcctgtgccatcgaaatgatccacaccatgtctttgatgcacgatgatttgccatgtatcgacaacgatgacttgagacgtggtaaacctaccaatcataagattttcggtgaagatactgctgttactgccggtaacgctttacactcttacgccttcgaacatattgctgtttctacttccaagactgttggtgctgatagaattttgagaatggtttctgaattaggtcgtgctactggttccgaaggtgttatgggtggtcaaatggtcgatattgcttctgaaggtgacccttccattgatttgcaaactttagaatggatccacatccacaagactgctatgttattagaatgttctgttgtctgtggtgccatcatcggtggtgcttctgaaattgttattgagagagccagacgttatgctcgttgtgtcggtttattgtttcaagttgttgacgacattttagatgttaccaaatcttctgacgaattgggtaaaactgctggtaaagatttaatctccgataaagccacctaccctaagttgatgggtttggagaaggccaaagagttttccgatgaattattaaacagagctaaaggtgaattgtcttgcttcgatccagttaaggctgccccattgttaggtttggctgactacgttgccttcagacaaaactaa

SEQ ID NO: 135 - protein, 257 aa, Artificial Sequence
  Truncated geranylgeranyl pyrophosphate synthase Pb_GPPS_NTrunc
MAAIFPSIPSNFKPPQISQTLTRRRRPNRTLCTATSDQSYLSASSADIYSHLLRSLPATIHPSVKAPIHSLLSSPIPPTIAPPLCLAATELVGGNPNSAINAACAIHLIHAVTHTRTAPPLAEFSPGVLLMTGDGLLVLAYEMLARSPAVDADTSVRVLKEVARTAAAVAAAYEGGREGELAAGAAACGVILGGGNEEEVERGRRVGMFAGKMELVEAEVELRLGFEDAKAGAVRRLLEEMRFTQSFVNVRNPFYGK

SEQ ID NO: 136 - DNA, 774 bp, Artificial Sequence
  Truncated geranylgeranyl pyrophosphate synthase Pb_GPPS_NTrunc
atggctgctatctttccatccattccatccaacttcaaaccacctcaaatctctcaaactttgaccagacgtagaagaccaaaccgtactttatgtactgccacctctgaccaatcttacttgtccgcttcttctgccgacatttattctcatttgttaagatctttaccagctactattcatccatctgttaaagccccaatccattctttattgtcctctccaattcctccaaccatcgctccacctttgtgtttagctgctaccgaattggttggtggtaaccctaactctgccattaacgccgcctgtgccattcatttgattcatgctgttactcatactagaaccgctccaccattagctgaattttctcctggtgttttgttgatgactggtgatggtttattagttttggcttacgagatgttggccagatccccagctgttgatgccgatacttctgtccgtgttttgaaggaagtcgctagaaccgccgccgccgtcgccgctgcttatgaaggtggtagagaaggtgaattagctgccggtgccgctgcttgtggtgtcattttgggtggtggtaacgaagaagaggtcgaaagaggtcgtagagtcggtatgttcgctggtaaaatggaattagttgaagctgaagtcgaattgagattgggtttcgaagatgctaaagccggtgccgttagaagattgttggaagaaatgcgtttcacccaatcttttgtcaacgttagaaaccctttttatggtaagtaa

SEQ ID NO: 137 - protein, 420 aa, Azadirachta indica
MLFSRGLSRISRIPRNSLIGCRWLVSYRPDTILSGSSHSVGDSTQKVLGCREAYLWSLPALHGIRHQIHQQSSSLIEEELDPFSLVADELSLVANRLRSMVVAEVPKLASAAEYFFKMGVEGKRFRPTVLLLMASALNVQVPQPLSDGVGDALTTELRTRQQCIAEITEMIHVASLLHDDVLDDADTRRGIGSLNFVMGNKLAVLAGDFLLSRACVALASLKNTEVVSLLATVVEHLVTGETMQMTTTAEQRRSMDYYMQKTYYKTASLISNSCKAIALLAGQTTEVAMLAFDYGKNLGLAFQLIDDVLDFTGTSASLGKGSLSDIRHGIVTAPILFAMEEFPELRKVVDKGFDDPSNVDIALEYLGKSRGIQRTRELAQKHANLATVALDSLPESNDDDVKKSRRALLDLAQRVITRNK

SEQ ID NO: 138 - DNA, 1263 bp, Azadirachta indica
atgttgttttccagaggtttatctcgtatttccagaatcccacgtaactctttgatcggttgtagatggttagtttcttaccgtcctgataccattttatctggttcctctcactccgttggtgactctactcaaaaggttttaggttgtcgtgaagcttacttgtggtctttaccagccttgcacggtattagacaccaaattcatcaacaatcctcttctttgattgaagaagaattggatccattctctttagttgctgatgaattgtctttagtcgctaaccgtttgagatccatggtcgtcgctgaagtcccaaaattagcctccgccgccgagtacttcttcaagatgggtgttgagggtaagagattccgtccaactgtcttattgttgatggcctccgccttaaacgttcaagtcccacaacctttgtctgacggtgttggtgatgctttgactaccgagttgagaactagacaacaatgcattgctgagattactgaaatgatccatgttgcttctttgttgcatgacgacgttttggatgatgctgacactagacgtggtatcggttctttgaacttcgttatgggtaacaagttggctgtcttggctggtgatttcttgttgtccagagcctgtgttgctttagcttccttgaagaatactgaggttgtctctttgttggccaccgttgttgaacacttggtcaccggtgaaactatgcaaatgactactactgctgaacaaagacgttccatggattattacatgcaaaagacttactataagaccgcctctttgatttccaactcttgtaaagccattgccttgttagctggtcaaactaccgaagttgctatgttggctttcgattacggtaagaatttgggtttagcttttcaattgatcgatgacgtcttggattttactggtacctctgcttctttaggtaaaggttccttgtctgatattagacacggtatcgttaccgctccaattttattcgctatggaagaattcccagaattaagaaaggttgttgataagggttttgacgacccttccaacgttgacattgctttggagtatttgggtaagtctagaggtattcaaagaaccagagaattggctcaaaaacatgccaatttggccaccgtcgccttggattctttaccagaatccaacgacgacgatgttaagaagtctcgtagagctttattggacttggctcaaagagttattactagaaacaagtaa

SEQ ID NO: 139 - protein, 513 aa, Artificial Sequence
  Truncated geranylgeranyl pyrophosphate synthase Es_GPPS_NTrunc
MRRSGSATAAAAATLARHANACCRARSPALGLLPGAAASSSTHRAALSSNSGHGGDGSGHYDAAMRRRESCASRSRHRWSGQEAAAASATTTTARRAPGGVAGASGQGSAAGSVRALSSSFLADAVRETATNHCIDRVVNGGLDGSVPVDKDTPTVEVQDFVYDIDFAQRPSGASQSLADGPDPFELVSAELAGLSDGIKSLIGTEHAVLNAAAKYFFELDGGKKIRPTMVILMSQACNSNSQQVRPDVQPGTELVNPLQLRLAEITEMIHAASLFHDDVIDEADTRRGVPSVNKVFGNKLAILAGDFLLARSSMSLARLRSLESVELMSAAIEHLVKGEVLQMRPTEDGGGAFEYYVRKNYYKTGSLMANSCKASAVLGQHDLEVQEVAFEYGKRVGLAFQLVDDILDFEGNTFTLGKPALNDLRQGLATAPVLLAAEQQPGLAKLISRKFRGPGDVDEALELVHRSDGIARAKEVAVVQAEKAMSAILTLHDSPAQNALVQLAHKIVNRNH

SEQ ID NO: 140 - DNA, 1542 bp, Artificial Sequence
  Truncated geranylgeranyl pyrophosphate synthase Es_GPPS_NTrunc
atgcgtagatccggttccgctaccgccgctgccgctgccaccttagccagacacgccaacgcctgttgtagagcccgttccccagctttaggtttgttgcctggtgccgccgcttcttcctctactcacagagccgccttgtcttctaattctggtcatggtggtgatggttccggtcattacgacgctgctatgagaagaagagaatcttgcgcttccagatctcgtcacagatggtccggtcaagaagctgccgccgcctccgccactaccaccaccgctcgtcgtgctccaggtggtgtcgccggtgcttctggtcaaggttctgctgccggttctgttagagccttatcctcttcttttttagccgatgccgttcgtgaaaccgctactaaccactgtatcgaccgtgttgtcaacggtggtttggacggttctgtcccagtcgataaagataccccaactgtcgaagttcaagactttgtttatgatattgactttgctcaacgtccatccggtgcctctcaatctttagctgacggtccagatccattcgagttagtttccgctgagttggccggtttgtctgatggtattaagtctttgattggtaccgaacatgctgtcttgaacgccgccgccaaatatttcttcgaattagatggtggtaaaaagatcagacctactatggttatcttaatgtcccaagcttgtaactctaattcccaacaagttcgtcctgacgttcaaccaggtactgaattagtcaatcctttgcaattaagattggctgaaatcaccgagatgattcatgctgcttctttattccacgacgatgttattgatgaggctgatactagacgtggtgtcccttctgttaataaagttttcggtaacaaattagccatcttggccggtgacttcttattggctagatcctctatgtccttggcccgtttaagatccttggagtccgtcgaattgatgtccgccgctatcgaacacttggtcaaaggtgaagttttacaaatgcgtccaactgaggacggtggtggtgctttcgagtactacgtcagaaaaaattactacaagactggttctttgatggctaactcctgtaaggcctccgccgttttaggtcaacacgacttagaagtccaagaggtcgcttttgaatacggtaagagagtcggtttggctttccaattggttgacgatattttagattttgaaggtaatactttcactttgggtaagccagctttaaacgacttgagacaaggtttagccactgcccctgtcttgttagctgctgaacaacaacctggtttagctaaattgatctccagaaagtttagaggtcctggtgatgtcgatgaagctttggaattggtccacagatccgacggtattgctagagctaaggaggttgctgttgtccaagccgaaaaagctatgtctgccattttgaccttgcatgactccccagctcaaaatgctttggttcaattggctcacaaaatcgtcaatcgtaaccattag

SEQ ID NO: 141 - protein, 415 aa, Solanum sp.
MIFSKGLAQISRNRFSRCRWLFSLRPIPQLHQSNHIHDPPKVLGCRVIHSWVSNALSGIGQQIHQQSTAVAEEQVDPFSLVADELSLLTNRLRSMVVAEVPKLASAAEYFFKLGVEGKRFRPTVLLLMATALNVQIPRSAPQVDVDSFSGDLRTRQQCIAEITEMIHVASLLHDDVLDDADTRRGIGSLNFVMGNKLAVLAGDFLLSRACVALASLKNTEVVCLLATVVEHLVTGETMQMTTSSDERCSMEYYMQKTYYKTASLISNSCKAIALLAGHSAEVSVLAFDYGKNLGLAFQLIDDVLDFTGTSATLGKGSLSDIRHGIVTAPILYAMEEFPQLRTLVDRGFDDPVNVEIALDYLGKSRGIQRTRELARKHASLASAAIDSLPESDDEEVQRSRRALVELTHRVITRTK

SEQ ID NO: 142 - DNA, 1248 bp, Solanum sp.
atgatcttttccaagggtttagctcaaatctctcgtaatagattctctcgttgcagatggttattctctttgcgtccaattcctcaattacaccaatccaatcacatccacgacccaccaaaagttttgggttgtcgtgtcattcactcttgggtttctaatgccttgtctggtatcggtcaacaaatccatcaacaatctactgccgttgccgaggaacaagtcgaccctttttctttggttgctgatgagttatccttgttaaccaacagattgagatccatggttgtcgctgaagtccctaagttagcctccgccgctgagtatttctttaagttaggtgtcgaaggtaaacgtttccgtccaactgtcttgttgttgatggccactgccttaaacgtccaaattcctcgttctgctccacaagttgacgttgactctttttctggtgacttgagaactagacaacaatgtatcgctgaaattactgaaatgattcacgtcgcctctttgttgcatgatgacgtcttagatgatgctgatactagaagaggtattggttccttaaattttgttatgggtaataagttggctgttttggctggtgatttcttgttatccagagcctgcgtcgccttagcctccttgaagaacaccgaagttgtctgtttattggccaccgttgtcgaacatttggttaccggtgaaactatgcaaatgactacctcctccgatgaaagatgttccatggaatactacatgcaaaagacctactataagactgcctctttgatttctaactcttgtaaagccattgccttgttagccggtcactctgctgaagtttctgtcttggccttcgattacggtaagaacttaggtttggcttttcaattgatcgacgatgttttggacttcaccggtacctctgctactttgggtaaaggttccttgtccgatatcagacatggtatcgttactgctcctattttgtatgctatggaagaattccctcaattacgtactttggttgacagaggtttcgatgatccagttaatgttgagatcgctttggattacttgggtaaatcccgtggtattcaaagaactagagaattagccagaaagcatgcctctttagcctctgccgccatcgattccttgcctgaatccgacgatgaggaagttcaaagatctcgtagagctttggtcgaattgacccatagagtcattactcgtactaagtaa

SEQ ID NO: 143 - protein, 330 aa, Hevea brasiliensis
MQFLRGLSPISRSGLRLFLSRQLYPFPVANSSQLLGDSTQKVFNRRETYSWSLVDSHGFKQQIHHQSSFLSEEPLDPFSLVADELSLVANRLRAMLVSEVPKLASAAEYFFKMGVEGKRLRPTVLLLMATALNVHIHEPMPNGVGDTLGAELRTRQQCIAEITEMIHVASLLHDDVLDDADTRRGIGSLNFVMGNKVAVLAGDFLLSRACVALASLKNTEVVSLLATVVEHLVTGETMQMTSTSEQRCSMDHYMQKTYYKTASLISDSCKAIALLAGQTTEVAMLAFEYGKSLGLAFQLIDDVLDFTGTSASLGKGSLSDIRHVIRLSLI

SEQ ID NO: 144 - DNA, 993 bp, Hevea brasiliensis
atgcaatttttgagaggtttgtcccctatttccagatccggtttgcgtttattcttatctcgtcaattatatccattcccagtcgccaactcctcccaattattaggtgactctactcaaaaggtttttaacagacgtgagacttactcttggtctttggtcgactctcacggttttaagcaacaaattcatcaccaatcctcttttttgtctgaagaaccattggatccattctctttggttgctgatgaattatccttggtcgctaacagattgcgtgctatgttggtttctgaagtcccaaaattagcctccgccgctgaatattttttcaagatgggtgttgaaggtaagagattgcgtccaaccgtcttgttattaatggccactgctttaaacgttcatatccatgaacctatgcctaacggtgttggtgacactttgggtgccgaattgagaactagacaacaatgcatcgctgaaatcaccgaaatgatccatgttgcttctttattacatgacgacgttttagacgatgccgataccagaagaggtattggttctttgaacttcgttatgggtaacaaggttgctgttttggccggtgactttttgttgtccagagcttgtgttgccttagcttctttgaagaataccgaagtcgtttctttattggccaccgtcgtcgaacacttggttactggtgagactatgcaaatgacctccacttctgagcaacgttgttccatggatcattatatgcaaaagacttactataagaccgcttccttaatctctgattcctgtaaagccatcgccttgttagctggtcaaactaccgaggtcgccatgttggccttcgaatatggtaagtctttgggtttagcttttcaattaatcgacgatgttttagacttcaccggtacttctgcttccttgggtaagggttctttgtccgacattagacacgttattagattatccttaatttaa

SEQ ID NO: 145 - protein, 566 aa, Artificial Sequence
  Mutant medium-chain fatty acid CoA ligase Ec_FADK_v1
MHPTGPHLGPDVLFRESNMKVTLTFNEQRRAAYRQQGLWGDASLADYWQQTARAMPDKIAVVDNHGASYTYSALDHAASCLANWMLAKGIESGDRIAFQLPGWCEFTVIYLACLKIGAVSVPLLPSWREAELVWVLNKCQAKMFFAPTLFKQTRPVDLILPLQNQLPQLQQIVGVDKLAPATSSLSLSQIIADNTSLTTAITTHGDELAAVLFTSGTEGLPKGVMLTHNNILASERAYCARLNLTWQDVFMMPAPLGHATGFLHGVTAPFLIGARSVLLDIFTPDACLALLEQQRCTCMLGATPFVYDLLNVLEKQPADLSALRFFLCGGTTIPKKVARECQQRGIKLLSVYGSTESSPHAVVNLDDPLSRFMHTDGYAAAGVEIKVVDDARKTLPPGCEGEEASRGPNVFMGYFDEPELTARALDEEGWYYSGDLCRMDEAGYIKITGRKKDIIVRGGENISSREVEDILLQHPKIHDACVVAMSDERLGERSCAYVVLKAPHHSLSLEEVVAFFSRKRVAKYKYPEHIVVIEKLPRTTSGKIQKFLLRKDIMRRLTQDVCEEIE

SEQ ID NO: 146 - DNA, 1701 bp, Escherichia coli
atgcatccaactggtccacacttaggtcctgatgtcttatttagagaatctaatatgaaagtcactttgacctttaatgaacaaagacgtgccgcttacagacaacaaggtttgtggggtgacgcttctttggctgactactggcaacaaactgctagagctatgccagacaagatcgccgttgtcgataaccacggtgcttcttatacctactctgctttggatcatgccgcttcttgtttggctaattggatgttggctaagggtatcgaatctggtgatcgtattgcttttcaattgccaggttggtgtgaatttaccgttatctacttggcttgtttgaagattggtgctgtttctgtcccattgttgccatcttggagagaagccgaattggtttgggttttgaacaaatgccaagctaagatgttctttgctccaaccttgttcaagcaaactagaccagttgacttgattttacctttacaaaatcaattaccacaattgcaacaaatcgttggtgttgacaagttagctccagccacctcctctttgtccttgtcccaaattatcgctgataatacttctttaaccaccgctatcactactcacggtgatgagttggctgctgttttgttcacttccggtactgagggtttgccaaagggtgttatgttgacccacaataacattttggcttccgaaagagcttattgtgctcgtttgaacttgacctggcaagatgttttcatgatgccagctccattgggtcatgctactggtttcttgcacggtgttactgccccattcttgattggtgctagatctgtcttgttggatatctttaccccagacgcttgcttagctttattggaacaacaaagatgtacctgtatgttaggtgctactccatttgtttacgatttattgaacgttttggaaaaacaaccagctgatttgtctgccttgagattctttttgtgtggtggtactactattccaaagaaagttgctagagaatgccaacaaagaggtatcaagttgttgtccgtctatggttccactgaatcttctcctcatgctgttgtcaatttagatgacccattgtctagattcatgcacaccgatggttacgccgctgctggtgttgagattaaggttgtcgacgatgctagaaagaccttacctccaggttgtgaaggtgaagaagcctctagaggtccaaatgtctttatgggttacttcgacgagccagaattgactgctagagctttagatgaggaaggttggtattactctggtgatttgtgtagaatggatgaagctggttacattaaaatcactggtagaaagaaggacattattgttagaggtggtgaaaatatctcctccagagaagttgaagatattttattgcaacacccaaagattcatgatgcttgtgttgttgctatgtccgatgagagattaggtgaaagatcttgtgcttacgttgttttgaaggctccacatcactctttgtctttagaagaagtcgttgctttcttctctagaaagagagtcgccaagtacaagtacccagaacacattgttgttatcgaaaaattgcctagaactacttctggtaaaattcaaaaattcttgttgagaaaggatatcatgagacgtttgacccaagatgtctgtgaagaaattgaataa

SEQ ID NO: 147 - protein, 566 aa, Escherichia coli; identical to SEQ ID NO: 145

SEQ ID NO: 148 - DNA, 1701 bp, Artificial Sequence
  Artificial medium-chain fatty acid CoA ligase Ec_FADK_v2 nucleotide sequence
atgcatccaactggtcctcacttaggtccagatgtcttattcagagaatctaacatgaaagtcactttaacttttaacgaacaacgtagagctgcttatagacaacaaggtttgtggggtgatgcttccttggctgactactggcaacaaactgctagagccatgccagataaaattgccgttgttgacaatcacggtgcttcttacacttattctgccttagatcacgctgcttcctgtttagctaactggatgttagctaagggtattgaatccggtgatagaattgctttccaattgccaggttggtgcgaatttactgtcatttatttagcttgtttaaagattggtgccgtctccgtccctttgttgccatcctggagagaggccgagttggtttgggttttaaacaagtgtcaagctaaaatgttctttgctcctaccttgttcaagcaaaccagaccagttgacttaattttgccattacaaaaccaattaccacaattgcaacaaatcgtcggtgttgataaattagctccagccacttcttctttgtccttatcccaaattattgctgataacacttctttaactactgctattactactcacggtgatgaattggccgctgttttgttcacttccggtactgaaggtttgcctaaaggtgtcatgttgactcacaacaacattttggcctctgaaagagcttactgtgcccgtttaaatttgacctggcaagatgtcttcatgatgcctgctccattgggtcacgctaccggtttcttacacggtgtcactgccccattcttgatcggtgctcgttctgttttattggatatctttactccagatgcttgcttggctttattggaacaacaaagatgtacctgcatgttaggtgctactcctttcgtctatgatttattgaacgtcttagaaaaacaaccagctgatttatccgctttaagattctttttgtgtggtggtactactatcccaaaaaaggtcgccagagaatgtcaacaaagaggtattaaattattgtccgtttatggttccactgaatcttcccctcatgctgttgtcaatttagacgaccctttgtccagattcatgcacactgatggttacgccgctgctggtgtcgaaatcaaggttgttgatgacgctagaaaaactttaccacctggttgcgaaggtgaagaggcttccagaggtccaaacgtctttatgggttactttgatgaaccagaattgactgccagagctttggatgaggaaggttggtattattctggtgatttgtgtagaatggatgaagccggttacatcaagatcaccggtagaaagaaagacatcatcgttagaggtggtgaaaacatttcttctagagaagttgaagacattttgttgcaacacccaaagatccacgacgcttgtgtcgtcgccatgtctgacgaaagattgggtgaacgttcttgtgcttacgtcgtcttgaaagccccacaccactctttgtctttggaagaagtcgttgcttttttctctcgtaagcgtgttgccaagtacaagtacccagagcacatcgttgttattgaaaaattgcctcgtactacttccggtaagattcaaaagttcttattacgtaaggacatcatgagaagattgactcaagacgtctgcgaagaaattgaataa

SEQ ID NO: 149 - protein, 521 aa, Artificial Sequence
  Truncated acyl activating enzyme (Cs_AAE3_Ctrunc)
MEKSGYGRDGIYRSLRPPLHLPNNNNLSMVSFLFRNSSSYPQKPALIDSETNQILSFSHFKSTVIKVSHGFLNLGIKKNDWLIYAPNSIHFPVCFLGIIASGAIATTSNPLYTVSELSKQVKDSNPKLIITVPQLLEKVKGFNLPTILIGPDSEQESSSDKVMTFNDLVNLGGSSGSEFPIVDDFKQSDTAALLYSSGTTGMSKGWLTHKNFIASSLMVTMEQDLVGEMDNVFLCFLPMFHVFGLAIITYAQLQRGNTVISARFDLEKMLKDVEKYVTHLWWPPVILALSKNSMVKFNLSSIKYIGSGAAPLGKDLMEECSKWPYGIVAQGYGMTETCGIVSMEDIRGGKRNSGSAGMLASGVEAQIVSVDTLKPLPPNQLGEIWVKGPNMMQGYFNNPQATKLTIDKKGWVHTGDLGYFDEDGHLYWDRIKELIKYKGFQVAPAELEGLLVSHPEILDAWIPFPDAEAGEVPVAYWRSPNSSLTENDVKKFIAGQVASFKRLRKVTFINSVPKSASGKIL

SEQ ID NO: 150 - DNA, 1563 bp, Artificial Sequence
  Truncated acyl activating enzyme (Cs_AAE3_Ctrunc)
atggaaaaatctggttatggtagagacggtatctacagatccttgcgtcctccattacacttgccaaacaataataacttatctatggtttcctttttgttccgtaactcttcctcttacccacaaaaacctgctttgattgactccgaaaccaatcaaatcttgtccttttcccacttcaaatctactgtcattaaagtctctcacggtttcttgaacttaggtattaagaagaacgactggttgatctacgctcctaattccatccactttccagtttgtttcttgggtatcattgcttctggtgccattgctaccacttctaaccctttatacactgtttctgagttatctaagcaagttaaagattctaacccaaaattgattatcactgtcccacaattattagaaaaggtcaagggtttcaatttaccaaccattttaatcggtccagactccgaacaagagtcttcttccgataaagttatgacttttaacgacttagttaacttgggtggttcttctggttctgagttcccaatcgtcgatgatttcaagcaatctgacaccgccgctttattgtattcctctggtactactggtatgtctaagggttggttgactcacaaaaactttatcgcttcctctttgatggttaccatggaacaagacttggttggtgaaatggataacgtcttcttgtgttttttaccaatgttccatgttttcggtttagctatcattacttacgctcaattacaaagaggtaacactgtcatctctgctcgttttgacttagaaaagatgttgaaagacgttgaaaagtacgttactcacttgtggtggcctcctgttattttagctttgtctaagaattctatggttaaattcaacttgtcctctatcaagtacattggttctggtgccgctccattaggtaaggacttgatggaagaatgttctaaatggccttacggtatcgtcgctcaaggttacggtatgactgaaacttgtggtatcgtttctatggaagacatcagaggtggtaagcgtaactccggttctgctggtatgttggcttccggtgttgaagcccaaattgtttctgtcgatactttgaaacctttgccacctaaccaattaggtgaaatttgggttaaaggtcctaacatgatgcaaggttacttcaataaccctcaagctactaagttaactattgataagaagggttgggttcatactggtgatttgggttacttcgatgaagatggtcatttgtactgggatagaatcaaagaattaattaagtataaaggtttccaagttgccccagctgaattggaaggtttgttggtttctcatcctgaaattttagatgcttggattcctttcccagacgctgaagccggtgaagttccagttgcttactggagatcccctaactcttccttgactgaaaacgacgtcaagaagttcatcgctggtcaagttgcttcctttaagagattaagaaaagtcaccttcatcaactccgttccaaagtctgcttccggtaagattttg

SEQ ID NO: 151 - protein, 518 aa, Artificial Sequence
  Truncated cannabidiolic acid synthase Cs_CBDASt28
MSNPRENFLKCFSQYIPNNATNLKLVYTQNNPLYMSVLNSTIHNLRFTSDTTPKPLVIVTPSHVSHIQGTILCSKKVGLQIRTRSGGHDSEGMSYISQVPFVIVDLRNMRSIKIDVHSQTAWVEAGATLGEVYYWVNEKNENLSLAAGYCPTVCAGGHFGGGGYGPLMRNYGLAADNIIDAHLVNVHGKVLDRKSMGEDLFWALRGGGAESFGIIVAWKIRLVAVPKSTMFSVKKIMEIHELVKLVNKWQNIAYKYDKDLLLMTHFITRNITDNQGKNKTAIHTYFSSVFLGGVDSLVDLMNKSFPELGIKKTDCRQLSWIDTIIFYSGVVNYDTDNFNKEILLDRSAGQNGAFKIKLDYVKKPIPESVFVQILEKLYEEDIGAGMYALYPYGGIMDEISESAIPFPHRAGILYELWYICSWEKQEDNEKHLNWIRNIYNFMTPYVSKNPRLAYLNYRDLDIGINDPKNPNNYTQARIWGEKYFGKNFDRLVKVKTLVDPNNFFRNEQSIPPLPRHRH

SEQ ID NO: 152 - DNA, 1557 bp, Artificial Sequence
  Truncated cannabidiolic acid synthase Cs_CBDASt28
atgtctaatccaagagagaatttcttaaagtgtttttctcaatacatcccaaacaatgctactaacttaaagttggtttacactcaaaataacccattgtacatgtctgtcttgaactctaccattcacaatttgcgttttacttctgacaccacccctaagccattagttattgttaccccatcccacgtctctcacatccaaggtactattttgtgttctaaaaaggttggtttgcaaattagaactagatctggtggtcacgactccgagggtatgtcttacatctctcaagttccattcgttattgtcgacttgcgtaacatgcgttccatcaaaatcgatgttcactcccaaactgcttgggtcgaagccggtgccactttaggtgaggtttattactgggtcaatgagaagaatgagaatttgtccttggctgctggttattgtccaaccgtctgtgctggtggtcattttggtggtggtggttacggtccattaatgagaaactatggtttggctgccgataacattatcgacgctcacttggttaatgtccacggtaaggtcttagatagaaaatccatgggtgaggacttgttctgggctttgagaggtggtggtgctgagtcctttggtatcatcgttgcttggaaaattcgtttagttgctgtcccaaaatctactatgttttctgttaagaagatcatggaaattcacgagttggttaagttggttaataagtggcaaaatattgcctacaagtatgacaaagacttgttattgatgactcacttcatcactagaaacatcaccgataaccaaggtaaaaataaaactgctatccatacctacttctcctccgttttcttgggtggtgtcgactccttagttgatttgatgaacaaatcttttcctgaattaggtatcaagaagactgattgtcgtcaattgtcctggattgataccattatcttttactctggtgtcgtcaattacgacaccgataatttcaataaggaaattttattggacagatctgccggtcaaaacggtgctttcaagatcaagttggactacgttaaaaaaccaatcccagaatccgtctttgtccaaattttggagaagttatacgaggaagacatcggtgctggtatgtatgccttatatccatacggtggtattatggatgaaatttccgaatctgctatcccatttccacatcgtgctggtattttgtatgaattatggtacatttgttcctgggaaaagcaagaagataacgagaagcacttgaattggatcagaaatatctacaatttcatgactccttacgtttctaagaatcctcgtttggcttacttgaactacagagatttggacatcggtattaatgacccaaagaacccaaataactatactcaagctagaatttggggtgaaaagtacttcggtaaaaactttgacagattggttaaggttaagactttagttgatccaaataacttcttcagaaatgaacaatccatcccaccattgcctagacacagacactaa

SEQ ID NO: 153 - protein, 519 aa, Artificial Sequence
  Truncated tetrahydrocannabinolic acid synthase Cs_THCASt28
MSNPRENFLKCFSKHIPNNVANPKLVYTQHDQLYMSILNSTIQNLRFISDTTPKPLVIVTPSNNSHIQATILCSKKVGLQIRTRSGGHDAEGMSYISQVPFVVVDLRNMHSIKIDVHSQTAWVEAGATLGEVYYWINEKNENLSFPGGYCPTVGVGGHFSGGGYGALMRNYGLAADNIIDAHLVNVDGKVLDRKSMGEDLFWAIRGGGGENFGIIAAWKIKLVAVPSKSTIFSVKKNMEIHGLVKLFNKWQNIAYKYDKDLVLMTHFITKNITDNHGKNKTTVHGYFSSIFHGGVDSLVDLMNKSFPELGIKKTDCKEFSWIDTTIFYSGVVNFNTANFKKEILLDRSAGKKTAFSIKLDYVKKPIPETAMVKILEKLYEEDVGAGMYVLYPYGGIMEEISESAIPFPHRAGIMYELWYTASWEKQEDNEKHINWVRSVYNFTTPYVSQNPRLAYLNYRDLDLGKTNHASPNNYTQARIWGEKYFGKNFNRLVKVKTKVDPNNFFRNEQSIPPLPPHHH

SEQ ID NO: 154 - DNA, 1560 bp, Artificial Sequence
  Truncated tetrahydrocannabinolic acid synthase Cs_THCASt28
atgtctaaccctcgtgagaacttcttgaaatgtttctccaaacatatcccaaacaatgtcgctaaccctaagttagtttacactcaacatgatcaattatatatgtctatcttgaactctaccatccaaaacttgagattcatctccgataccaccccaaaaccattggttattgttaccccatccaacaattctcatattcaagctaccattttgtgctccaaaaaggtcggtttgcaaatccgtactagatctggtggtcacgatgctgaaggtatgtcttacatttcccaagtcccattcgttgttgtcgatttaagaaatatgcactctatcaaaatcgacgttcactctcaaactgcttgggttgaagccggtgccactttaggtgaggtttactactggattaacgaaaagaatgaaaacttatcctttccaggtggttactgtccaactgttggtgttggtggtcacttctctggtggtggttatggtgccttgatgagaaactacggtttagctgctgataatattatcgacgctcacttggttaatgtcgacggtaaggttttggacagaaaatccatgggtgaagatttattctgggccattagaggtggtggtggtgaaaacttcggtatcattgctgcttggaaaattaaattggtcgctgtcccatccaagtctactattttctccgtcaagaaaaacatggaaattcatggtttggttaaattattcaacaagtggcaaaacattgcttacaaatacgacaaagacttagttttgatgacccacttcattactaaaaacattaccgacaaccatggtaaaaataaaactactgttcacggttacttctcttccatttttcatggtggtgtcgactccttggtcgatttaatgaacaaatctttccctgagttgggtatcaagaagaccgactgtaaagaattctcttggatcgacactactattttctactctggtgtcgttaacttcaacaccgctaatttcaagaaggaaattttattagatagatccgctggtaaaaagaccgctttctctatcaaattagactacgttaaaaaaccaatcccagaaaccgctatggtcaaaatcttggaaaaattatatgaagaagacgttggtgccggtatgtacgtcttatatccatatggtggtattatggaagagatctctgaatccgctatcccttttccacacagagccggtattatgtacgaattatggtacactgcttcctgggagaaacaagaagataatgaaaagcacattaactgggttagatctgtttacaacttcactactccatacgtctctcaaaacccaagattagcctacttaaactaccgtgatttggatttaggtaaaactaatcacgcttccccaaacaactacacccaagctagaatttggggtgagaagtactttggtaagaacttcaaccgtttagtcaaggtcaagactaaagttgatccaaacaattttttcagaaacgaacaatctatcccacctttaccaccacaccaccattag

SEQ ID NO: 155 - protein, 545 aa, Cannabis sativa
MNCSAFSFWFVCKIIFFFLSFHIQISIANPRENFLKCFSKHIPNNVANPKLVYTQHDQLYMSILNSTIQNLRFISDTTPKPLVIVTPSNNSHIQATILCSKKVGLQIRTRSGGHDAEGMSYISQVPFVVVDLRNMHSIKIDVHSQTAWVEAGATLGEVYYWINEKNENLSFPGGYCPTVGVGGHFSGGGYGALMRNYGLAADNIIDAHLVNVDGKVLDRKSMGEDLFWAIRGGGGENFGIIAAWKIKLVAVPSKSTIFSVKKNMEIHGLVKLFNKWQNIAYKYDKDLVLMTHFITKNITDNHGKNKTTVHGYFSSIFHGGVDSLVDLMNKSFPELGIKKTDCKEFSWIDTTIFYSGVVNFNTANFKKEILLDRSAGKKTAFSIKLDYVKKPIPETAMVKILEKLYEEDVGAGMYVLYPYGGIMEEISESAIPFPHRAGIMYELWYTASWEKQEDNEKHINWVRSVYNFTTPYVSQNPRLAYLNYRDLDLGKTNHASPNNYTQARIWGEKYFGKNFNRLVKVKTKVDPNNFFRNEQSIPPLPPHHH

SEQ ID NO: 156 - DNA, 1638 bp, Cannabis sativa
atgaattgttctgctttctctttctggttcgtttgtaagatcatctttttcttcttatctttccatattcaaatctctatcgctaaccctcgtgagaacttcttgaaatgtttctccaaacatatcccaaacaatgtcgctaaccctaagttagtttacactcaacatgatcaattatatatgtctatcttgaactctaccatccaaaacttgagattcatctccgataccaccccaaaaccattggttattgttaccccatccaacaattctcatattcaagctaccattttgtgctccaaaaaggtcggtttgcaaatccgtactagatctggtggtcacgatgctgaaggtatgtcttacatttcccaagtcccattcgttgttgtcgatttaagaaatatgcactctatcaaaatcgacgttcactctcaaactgcttgggttgaagccggtgccactttaggtgaggtttactactggattaacgaaaagaatgaaaacttatcctttccaggtggttactgtccaactgttggtgttggtggtcacttctctggtggtggttatggtgccttgatgagaaactacggtttagctgctgataatattatcgacgctcacttggttaatgtcgacggtaaggttttggacagaaaatccatgggtgaagatttattctgggccattagaggtggtggtggtgaaaacttcggtatcattgctgcttggaaaattaaattggtcgctgtcccatccaagtctactattttctccgtcaagaaaaacatggaaattcatggtttggttaaattattcaacaagtggcaaaacattgcttacaaatacgacaaagacttagttttgatgacccacttcattactaaaaacattaccgacaaccatggtaaaaataaaactactgttcacggttacttctcttccatttttcatggtggtgtcgactccttggtcgatttaatgaacaaatctttccctgagttgggtatcaagaagaccgactgtaaagaattctcttggatcgacactactattttctactctggtgtcgttaacttcaacaccgctaatttcaagaaggaaattttattagatagatccgctggtaaaaagaccgctttctctatcaaattagactacgttaaaaaaccaatcccagaaaccgctatggtcaaaatcttggaaaaattatatgaagaagacgttggtgccggtatgtacgtcttatatccatatggtggtattatggaagagatctctgaatccgctatcccttttccacacagagccggtattatgtacgaattatggtacactgcttcctgggagaaacaagaagataatgaaaagcacattaactgggttagatctgtttacaacttcactactccatacgtctctcaaaacccaagattagcctacttaaactaccgtgatttggatttaggtaaaactaatcacgcttccccaaacaactacacccaagctagaatttggggtgagaagtactttggtaagaacttcaaccgtttagtcaaggtcaagactaaagttgatccaaacaattttttcagaaacgaacaatctatcccacctttaccaccacaccaccattag

SEQ ID NO: 157 - DNA, 1197 bp, Artificial Sequence
  Artificial Erg10p: acetoacetyl CoA thiolase nucleotide sequence
atgtcccaaaatgtttacattgtttctactgctagaactcctatcggttccttccaaggttccttatcttccaaaactgccgtcgaattgggtgccgttgccttgaaaggtgctttagctaaagttccagagttagacgcttccaaagatttcgatgaaattatcttcggtaacgttttatccgctaacttgggtcaagctccagccagacaagttgccttggctgccggtttgtctaatcacatcgttgcttctactgtcaacaaagtttgtgcctctgctatgaaagctatcattttaggtgcccaatctattaaatgtggtaatgctgacgttgttgtcgctggtggttgtgagtccatgaccaacgccccttactacatgccagccgccagagccggtgccaaattcggtcaaactgttttggttgacggtgttgaaagagatggtttgaacgatgcctatgacggtttggctatgggtgttcacgctgaaaagtgtgctagagactgggacattaccagagaacaacaagataatttcgctattgaatcttaccaaaagtcccaaaaatctcaaaaggaaggtaagtttgacaatgaaatcgttccagttactatcaagggttttcgtggtaagcctgatactcaagtcaccaaggatgaagaaccagcccgtttacacgtcgaaaagttgagatctgccagaaccgttttccaaaaagaaaacggtaccgttactgctgccaatgcttctccaatcaacgatggtgccgctgctgttattttagtctctgagaaggttttgaaggagaaaaatttgaagcctttagccatcattaagggttggggtgaagctgctcaccaaccagctgatttcacttgggccccttctttagctgtcccaaaggctttaaaacacgctggtattgaagatatcaactctgttgactacttcgaattcaatgaagctttctctgtcgtcggtttggtcaataccaaaatcttgaagttggatccttctaaggttaacgtttacggtggtgctgtcgccttaggtcaccctttaggttgttctggtgctagagttgttgtcaccttgttgtccattttacaacaagaaggtggtaagatcggtgttgctgctatctgtaacggtggtggtggtgcttcttccattgtcatcgaaaagatctag

SEQ ID NO: 158 - DNA, 1191 bp, Artificial Sequence
  Artificial mevalonate pyrophosphate decarboxylase (Sc_ERG19) nucleotide sequence
atgactgtctacactgcctccgttactgcccctgtcaacattgccaccttgaagtattggggtaaaagagatactaaattgaacttaccaactaactcctccatttctgtcactttgtctcaagatgatttgagaaccttgacttccgctgccaccgcccctgaatttgagagagatactttgtggttaaatggtgaacctcattctattgacaacgaaagaacccaaaactgtttacgtgacttgagacaattgcgtaaggaaatggaatctaaagacgcttctttacctaccttgtctcaatggaaattgcatatcgtttctgaaaataacttccctactgctgccggtttggcttcctccgctgctggttttgctgctttagtttctgccatcgccaaattatatcaattgccacaatccacttccgaaatctctagaatcgctagaaaaggttccggttctgcttgtagatccttgttcggtggttacgttgcttgggaaatgggtaaagctgaagacggtcatgattctatggccgttcaaattgccgactcctccgattggcctcaaatgaaagcttgtgtcttggttgtctccgatatcaaaaaggatgtctcttctactcaaggtatgcaattaactgttgccacttccgaattgttcaaagagcgtatcgaacacgttgttccaaagagatttgaagttatgagaaaagctatcgtcgaaaaggacttcgctacctttgccaaggagactatgatggattctaactccttccacgctacttgtttggattcctttccacctattttctacatgaatgacacctccaaacgtattatctcttggtgtcacaccattaaccaattttatggtgaaactatcgtcgcttacactttcgatgccggtccaaacgctgtcttgtactatttggctgaaaacgaatccaagttatttgcttttatctataagttgttcggttccgtccctggttgggacaagaaattcaccactgaacaattggaagctttcaaccaccaattcgaatcttccaatttcactgctagagaattagatttggaattacaaaaggatgtcgctagagtcatcttaactcaagttggttccggtccacaagaaactaacgaatctttgattgatgctaaaactggtttgcctaaagaataa

SEQ ID NO: 159 - DNA, 867 bp, Artificial Sequence
  Artificial isopentenyl pyrophosphate isomerase Sc_IDI1 nucleotide sequence
atgaccgctgacaacaactccatgccacatggtgctgtctcctcctacgctaaattagtccaaaaccaaacccctgaagacattttagaagagttccctgaaatcattccattgcaacaaagaccaaacactagatcctccgagacttctaacgatgaatctggtgaaacttgtttttctggtcatgatgaagaacaaatcaagttgatgaacgagaattgtattgttttggactgggatgacaacgctatcggtgctggtaccaaaaaggtctgtcacttgatggaaaacatcgaaaagggtttgttgcatagagccttttccgtcttcatcttcaacgaacaaggtgagttattattgcaacaaagagccactgaaaaaatcacctttccagatttatggaccaacacctgttgctcccatccattgtgtattgatgatgaattgggtttgaaaggtaagttggacgacaagattaaaggtgccatcaccgccgctgttcgtaagttagaccatgaattgggtatccctgaagacgaaactaagactagaggtaaattccatttcttgaatcgtattcactacatggctccttccaatgaaccatggggtgaacacgaaatcgactacattttgttttacaaaattaatgctaaagaaaatttaaccgttaacccaaacgtcaacgaggttagagatttcaagtgggtctctccaaacgatttgaagactatgttcgctgacccatcctacaagttcactccatggtttaagatcatctgtgaaaactatttgtttaactggtgggagcaattggacgacttatctgaagttgaaaatgatcgtcaaattcaccgtatgttgtaa

SEQ ID NO: 160 - DNA, 1356 bp, Artificial Sequence
  Artificial phosphomevalonate kinase Sc_ERG8 nucleotide sequence
atgtccgagttaagagccttctccgctcctggtaaagccttattagctggtggttacttagtcttggatactaaatatgaagccttcgtcgtcggtttatctgccagaatgcatgccgtcgcccatccatacggttccttgcaaggttctgacaagtttgaggtccgtgtcaagtctaaacaattcaaagatggtgaatggttgtatcatatttctccaaaatccggtttcattccagtttctatcggtggttctaagaacccattcatcgaaaaagtcatcgctaacgttttctcttacttcaagcctaatatggatgattattgcaatagaaatttattcgttattgatatcttctccgatgacgcctatcattcccaagaagactctgttaccgagcatagaggtaacagaagattatctttccactctcacagaattgaagaagttccaaaaactggtttaggttcttctgctggtttagtcaccgttttaaccactgccttggcttctttctttgtttccgacttagaaaataacgtcgacaagtatcgtgaagtcatccacaacttggcccaagttgctcattgtcaagctcaaggtaagattggttccggtttcgatgttgctgccgccgcctacggttccatcagatatagaagattccctccagctttgatttctaacttaccagatattggttctgctacttatggttccaagttggctcacttggttgacgaagaagattggaacattaccatcaagtccaatcacttgccatctggtttaactttgtggatgggtgatatcaagaacggttctgaaactgtcaaattggtccaaaaggtcaaaaattggtacgattcccatatgccagagtctttgaagatctatactgaattggaccacgctaactctcgtttcatggatggtttgtctaagttggacagattgcatgaaactcacgacgactactctgaccaaattttcgagtccttggaaagaaacgactgcacttgtcaaaagtatccagaaatcaccgaggttagagatgccgttgctactattagaagatccttcagaaagattaccaaggaatctggtgctgatattgagcctccagttcaaacttctttgttggatgattgccaaactttaaaaggtgttttaacttgtttaattcctggtgctggtggttacgacgccatcgccgttatcaccaaacaagacgtcgacttaagagcccaaactgccaacgacaaaagattctccaaggttcaatggttggacgtcactcaagctgattggggtgttagaaaagaaaaggacccagagacttacttggataaatag

SEQ ID NO: 161 - DNA, 1059 bp, Artificial Sequence
  Mutant farnesyl pyrophosphate synthase (Erg20mut, F96W, N127W)
atggcttctgagaaggagattcgtcgtgagagattcttgaatgtttttcctaaattagtcgaggaattgaacgcttctttgttggcttatggtatgcctaaggaagcttgtgattggtatgctcactccttgaattataatactccaggtggtaaattgaaccgtggtttgtctgttgttgacacttacgctattttatctaacaagaccgtcgagcaattgggtcaagaagagtatgaaaaggtcgctattttaggttggtgtattgaattgttgcaagcttactggttggttgccgatgacatgatggacaagtctattactcgtcgtggtcaaccttgctggtataaggtcccagaggttggtgaaattgctatctgggacgctttcatgttggaagctgctatctataaattgttgaaatcccacttcagaaacgagaaatactacattgacatcaccgagttgttccacgaagtcactttccaaactgagttaggtcaattaatggacttgatcaccgctccagaagacaaagttgacttgtccaagttttccttgaaaaagcactctttcatcgttactttcaagactgcttattactctttctacttaccagttgccttggctatgtacgtcgccggtatcactgacgaaaaggacttgaagcaagctcgtgacgttttgattccattaggtgaatatttccaaatccaagatgactacttagactgttttggtacccctgaacaaatcggtaagatcggtactgatattcaagataacaagtgctcttgggttatcaacaaggctttagagttagcctccgccgaacaacgtaaaactttagatgaaaactacggtaaaaaagactctgttgctgaggccaagtgtaagaagatttttaacgatttaaaaatcgaacaattgtatcacgaatatgaagagtccattgctaaggatttgaaggctaaaatttctcaagttgacgaatcccgtggtttcaaagctgacgttttgactgcttttttaaacaaggtttacaagcgttccaaataa

SEQ ID NO: 162 - DNA, 1158 bp, Artificial Sequence
  Artificial tetraketide synthase (TKS) nucleotide sequence
atgaaccatttaagagctgagggtccagcttccgtcttggctatcggtactgctaatccagagaacattttattacaagatgagtttccagattactatttccgtgttactaagtccgagcatatgacccaattgaaagaaaagttccgtaaaatctgtgataaatctatgattagaaaaagaaactgctttttaaacgaagaacacttgaagcaaaacccaagattagttgaacacgagatgcaaaccttggacgctagacaagatatgttggttgtcgaggttcctaaattgggtaaagacgcctgtgctaaagctatcaaagagtggggtcaacctaagtccaagatcactcacttaatcttcacttccgcttccaccactgacatgcctggtgctgattaccactgtgccaagttgttgggtttgtctccttctgtcaagagagttatgatgtaccaattaggttgttacggtggtggtactgtcttaagaattgctaaggacatcgctgaaaacaacaaaggtgctagagttttagccgtttgttgtgacatcatggcttgtttatttcgtggtccatctgaatctgacttggagttgttggttggtcaagctatttttggtgatggtgccgctgccgtcatcgttggtgctgagccagatgaatccgttggtgaaagaccaattttcgaattagtctctactggtcaaactattttgccaaactccgagggtactatcggtggtcatattcgtgaagccggtttaatctttgatttgcacaaagacgttccaatgttgatctctaacaacatcgaaaagtgtttaattgaggcttttactccaattggtatctctgactggaactctatcttctggatcactcatccaggtggtaaggctatcttggacaaggttgaagaaaaattacatttaaagtccgataaattcgtcgattctcgtcatgttttgtctgaacacggtaacatgtcttcctccactgtcttgtttgttatggatgaattacgtaagagatctttggaggagggtaagtctactactggtgatggtttcgaatggggtgttttgttcggtttcggtcctggtttgactgttgaacgtgttgttgttagatctgttccaattaagtactag

SEQ ID NO: 163 - DNA, 306 bp, Artificial Sequence
  Artificial olivetolic acid cyclase (OAC) nucleotide sequence
atggccgtcaaacacttgatcgtcttaaaattcaaggatgaaattactgaagctcaaaaagaagagttcttcaaaacctatgtcaatttagtcaacattattcctgctatgaaggacgtttactggggtaaggatgtcacccaaaagaacaaggaagaaggttacactcacattgttgaagtcactttcgaatctgttgaaactatccaagattatattatccacccagctcatgtcggttttggtgatgtttacagatctttttgggaaaaattgttgatctttgactatactccaagaaaataa

SEQ ID NO: 164 - DNA, 2163 bp, Artificial Sequence
  Artificial acyl-activating enzyme Cs_AAE1_v1 nucleotide sequence
atgggtaagaattacaagtccttagactctgttgttgcttctgactttattgctttaggtattacttccgaagttgctgaaaccttacacggtagattggctgaaattgtttgcaactacggtgctgctacccctcaaacttggattaacattgctaatcatattttgtctccagatttgccattttctttacaccaaatgttgttctacggttgttacaaggatttcggtcctgctcctccagcttggattcctgatccagaaaaagtcaaatctactaacttgggtgctttgttggaaaagagaggtaaggagtttttgggtgttaagtacaaggacccaatttcttctttctctcacttccaagaattctctgttagaaaccctgaagtttactggagaactgttttgatggatgagatgaagatttctttttctaaggacccagagtgtatcttaagaagagacgacattaacaatccaggtggttctgagtggttaccaggtggttacttgaactctgccaaaaattgcttgaacgttaactctaacaagaaattgaatgacactatgattgtctggagagatgagggtaacgatgatttgcctttgaataaattgactttggatcaattgagaaaaagagtctggttggttggttacgctttggaagaaatgggtttagaaaaaggttgtgctatcgccatcgatatgcctatgcacgttgatgctgttgttatttatttggctattgttttagctggttatgttgttgtttccatcgccgactccttctctgctccagaaatctccaccagattgagattgtctaaagccaaagccattttcacccaagaccacatcattagaggtaagaagcgtattccattgtattctcgtgttgttgaagctaaatctcctatggctatcgtcatcccatgctctggttctaacatcggtgctgaattaagagacggtgatatttcttgggactactttttagaaagagctaaagaattcaaaaactgcgagtttactgctagagaacaacctgtcgacgcttatactaatattttattctcttctggtactactggtgaacctaaggctattccatggacccaagctactcctttgaaagccgctgctgatggttggtcccatttagacatcagaaaaggtgatgtcatcgtctggccaactaacttaggttggatgatgggtccatggttagtctacgcttctttgttgaatggtgcctctatcgccttatataatggttcccctttagtctctggttttgctaaattcgttcaagatgctaaggttaccatgttaggtgttgtcccttctatcgttagatcttggaaatctactaactgtgtttctggttacgactggtccactattcgttgtttctcttcttctggtgaagcttccaatgtcgatgagtacttatggttaatgggtcgtgctaactacaagccagtcatcgaaatgtgcggtggtactgaaattggtggtgctttttccgctggttcttttttacaagcccaatccttgtcttccttctcctctcaatgtatgggttgtactttatatatcttagataagaatggttaccctatgcctaaaaacaagccaggtattggtgaattagctttgggtcctgttatgtttggtgcttctaaaaccttgttaaatggtaatcatcacgacgtttacttcaaaggtatgcctactttgaacggtgaggttttgagacgtcatggtgatattttcgaattaacttccaacggttattatcacgctcacggtagagctgatgatactatgaacattggtggtattaagatctcttccatcgaaattgagagagtttgtaacgaggttgacgatcgtgttttcgaaactactgctattggtgtccctcctttaggtggtggtccagaacaattggttatctttttcgtcttgaaggactccaacgacaccactatcgacttaaaccaattaagattgtctttcaacttgggtttgcaaaagaagttgaatccattatttaaggttactcgtgtcgttccattgtcctccttgccaagaactgctaccaacaagattatgcgtagagtcttgagacaacaattctctcactttgagtaa

SEQ ID NO: 165 - DNA, 2163 bp, Artificial Sequence
  Artificial acyl-activating enzyme Cs_AAE1_v2 nucleotide sequence
atgggtaagaactacaaatccttagattccgtcgtcgcttctgatttcatcgctttgggtattacttctgaagttgctgaaaccttgcatggtagattggctgaaattgtctgtaactacggtgctgctaccccacaaacttggatcaacattgctaaccacatcttatcccctgacttgccattctccttacaccaaatgttgttctacggttgttataaagatttcggtccagctcctcctgcttggattcctgacccagagaaggttaagtctactaatttaggtgctttgttagagaagagaggtaaggaatttttaggtgttaagtataaagatccaatttcttccttctctcacttccaagaattttctgttagaaacccagaagtttactggagaactgttttgatggatgaaatgaagatctctttttccaaggacccagagtgtattttgagacgtgatgacatcaacaatccaggtggttctgagtggttaccaggtggttacttgaactctgccaagaattgtttgaacgttaactctaacaaaaagttgaacgataccatgattgtttggagagacgaaggtaacgatgatttgccattgaataagttaaccttggatcaattgagaaaaagagtctggttagtcggttacgctttggaagagatgggtttggaaaagggttgtgctatcgccatcgatatgccaatgcatgttgatgctgttgttatctatttggccattgttttggctggttacgttgttgtttccatcgctgactccttctctgctccagaaatttctactagattaagattgtctaaagccaaagccattttcactcaagaccatattattagaggtaagaaaagaattccattgtattccagagttgttgaagctaaatccccaatggccatcgtcatcccatgctctggttctaatattggtgccgaattgagagacggtgatatctcttgggactactttttggagcgtgctaaagaatttaaaaactgcgaattcaccgccagagaacaaccagttgacgcctacactaacattttgttttcttctggtactactggtgaacctaaggctattccatggactcaagctactccattgaaagccgccgccgatggttggtcccacttagatattagaaagggtgatgtcatcgtctggcctactaacttgggttggatgatgggtccttggttggtttacgcttccttattgaacggtgcctctatcgctttatataatggttcccctttagtttctggttttgctaaattcgttcaagatgctaaggttactatgttgggtgtcgtcccatccattgtccgttcctggaagtctaccaattgtgtttctggttatgattggtctactattcgttgtttttcttcctctggtgaagcttctaatgtcgatgaatatttgtggttaatgggtagagctaactacaagccagttattgaaatgtgtggtggtactgaaattggtggtgctttctctgctggttcctttttgcaagctcaatccttgtcttctttctcctcccaatgtatgggttgcactttatacatcttggacaagaatggttaccctatgccaaagaataaaccaggtattggtgaattggctttgggtccagtcatgttcggtgcttctaagactttgttgaacggtaaccatcatgacgtctacttcaagggtatgcctaccttgaacggtgaagttttaagacgtcacggtgacattttcgaattgacttccaacggttattatcatgctcacggtagagctgacgacactatgaacatcggtggtattaagatctcttctatcgaaattgaaagagtttgcaacgaggttgatgatcgtgtcttcgaaaccactgctattggtgtccctcctttaggtggtggtcctgagcaattggttattttctttgtcttaaaggattctaacgacaccactattgacttaaatcaattgagattgtccttcaatttgggtttgcaaaagaagttgaacccattattcaaggttactcgtgtcgttcctttgtcctctttgccaagaaccgctaccaataaaattatgagacgtgttttgcgtcaacaattctctcactttgaataa

SEQ ID NO: 166 - DNA, 1602 bp, Artificial Sequence
  Artificial acyl-activating enzyme Cs_AAE3 nucleotide sequence
atggaaaaatctggttatggtagagacggtatctacagatccttgcgtcctccattacacttgccaaacaataataacttatctatggtttcctttttgttccgtaactcttcctcttacccacaaaaacctgctttgattgactccgaaaccaatcaaatcttgtccttttcccacttcaaatctactgtcattaaagtctctcacggtttcttgaacttaggtattaagaagaacgactggttgatctacgctcctaattccatccactttccagtttgtttcttgggtatcattgcttctggtgccattgctaccacttctaaccctttatacactgtttctgagttatctaagcaagttaaagattctaacccaaaattgattatcactgtcccacaattattagaaaaggtcaagggtttcaatttaccaaccattttaatcggtccagactccgaacaagagtcttcttccgataaagttatgacttttaacgacttagttaacttgggtggttcttctggttctgagttcccaatcgtcgatgatttcaagcaatctgacaccgccgctttattgtattcctctggtactactggtatgtctaagggttggttgactcacaaaaactttatcgcttcctctttgatggttaccatggaacaagacttggttggtgaaatggataacgtcttcttgtgttttttaccaatgttccatgttttcggtttagctatcattacttacgctcaattacaaagaggtaacactgtcatctctgctcgttttgacttagaaaagatgttgaaagacgttgaaaagtacgttactcacttgtggtggcctcctgttattttagctttgtctaagaattctatggttaaattcaacttgtcctctatcaagtacattggttctggtgccgctccattaggtaaggacttgatggaagaatgttctaaatggccttacggtatcgtcgctcaaggttacggtatgactgaaacttgtggtatcgtttctatggaagacatcagaggtggtaagcgtaactccggttctgctggtatgttggcttccggtgttgaagcccaaattgtttctgtcgatactttgaaacctttgccacctaaccaattaggtgaaatttgggttaaaggtcctaacatgatgcaaggttacttcaataaccctcaagctactaagttaactattgataagaagggttgggttcatactggtgatttgggttacttcgatgaagatggtcatttgtactgggatagaatcaaagaattaattaagtataaaggtttccaagttgccccagctgaattggaaggtttgttggtttctcatcctgaaattttagatgcttggattcctttcccagacgctgaagccggtgaagttccagttgcttactggagatcccctaactcttccttgactgaaaacgacgtcaagaagttcatcgctggtcaagttgcttcctttaagagattaagaaaagtcaccttcatcaactccgttccaaagtctgcttccggtaagattttgagaagagaattaatccaaaaggttcgttccaacatgtag

SEQ ID NO: 167 - DNA, 1635 bp, Artificial Sequence
  Artificial cannabidiolic acid synthase (CBDAS) nucleotide sequence
atgaaatgttccaccttttctttctggtttgtttgtaagatcatcttcttcttcttctccttcaacatccaaacttccatcgctaatccaagagagaatttcttaaagtgtttttctcaatacatcccaaacaatgctactaacttaaagttggtttacactcaaaataacccattgtacatgtctgtcttgaactctaccattcacaatttgcgttttacttctgacaccacccctaagccattagttattgttaccccatcccacgtctctcacatccaaggtactattttgtgttctaaaaaggttggtttgcaaattagaactagatctggtggtcacgactccgagggtatgtcttacatctctcaagttccattcgttattgtcgacttgcgtaacatgcgttccatcaaaatcgatgttcactcccaaactgcttgggtcgaagccggtgccactttaggtgaggtttattactgggtcaatgagaagaatgagaatttgtccttggctgctggttattgtccaaccgtctgtgctggtggtcattttggtggtggtggttacggtccattaatgagaaactatggtttggctgccgataacattatcgacgctcacttggttaatgtccacggtaaggtcttagatagaaaatccatgggtgaggacttgttctgggctttgagaggtggtggtgctgagtcctttggtatcatcgttgcttggaaaattcgtttagttgctgtcccaaaatctactatgttttctgttaagaagatcatggaaattcacgagttggttaagttggttaataagtggcaaaatattgcctacaagtatgacaaagacttgttattgatgactcacttcatcactagaaacatcaccgataaccaaggtaaaaataaaactgctatccatacctacttctcctccgttttcttgggtggtgtcgactccttagttgatttgatgaacaaatcttttcctgaattaggtatcaagaagactgattgtcgtcaattgtcctggattgataccattatcttttactctggtgtcgtcaattacgacaccgataatttcaataaggaaattttattggacagatctgccggtcaaaacggtgctttcaagatcaagttggactacgttaaaaaaccaatcccagaatccgtctttgtccaaattttggagaagttatacgaggaagacatcggtgctggtatgtatgccttatatccatacggtggtattatggatgaaatttccgaatctgctatcccatttccacatcgtgctggtattttgtatgaattatggtacatttgttcctgggaaaagcaagaagataacgagaagcacttgaattggatcagaaatatctacaatttcatgactccttacgtttctaagaatcctcgtttggcttacttgaactacagagatttggacatcggtattaatgacccaaagaacccaaataactatactcaagctagaatttggggtgaaaagtacttcggtaaaaactttgacagattggttaaggttaagactttagttgatccaaataacttcttcagaaatgaacaatccatcccaccattgcctagacacagacactaa

SEQ ID NO: 168 - DNA, 2235 bp, Saccharomyces sp.
atggccgctccagattatgcacttaccgatttaattgaatcggatcctcgtttcgaaagtttgaagacaagattagccggttacaccaaaggctctgatgaatatattgaagagctatactctcaattaccactgaccagctaccccaggtacaaaacatttttaaagaaacaggcggttgccatttcgaatccggataatgaagctggttttagctcgatttataggagttctctttcttctgaaaatctagtgagctgtgtggataaaaacttaagaactgcatacgatcacttcatgttttctgcaaggagatggcctcaacgtgactgtttaggttcaaggccaattgataaagccacaggcacctgggaggaaacattccgtttcgagtcgtactccacggtatctaaaagatgtcataatatcggaagtggtatattgtctttggtaaacacgaaaaggaaacgtcctttggaagccaatgattttgttgttgctatcttatcacacaacaaccctgaatggatcctaacagatttggcctgtcaggcctattctctaactaacacggctttgtacgaaacattaggtccaaacacctccgagtacatattgaatttaaccgaggcccccattctgatttttgcaaaatcaaatatgtatcatgtattgaagatggtgcctgatatgaaatttgttaatactttggtttgtatggatgaattaactcatgacgagctccgtatgctaaatgaatcgttgctacccgttaagtgcaactctctcaatgaaaaaatcacatttttttcattggagcaggtagaacaagttggttgctttaacaaaattcctgcaattccacctaccccagattccttgtatactatttcgtttacttctggtactacaggtttacctaaaggtgtggaaatgtctcacagaaacattgcgtctgggatagcatttgctttttctaccttcagaataccgccagataaaagaaaccaacagttatatgatatgtgttttttgccattggctcatatttttgaaagaatggttattgcgtatgatctagccatcgggtttggaataggcttcttacataaaccagacccaactgtattggtagaggatttgaagattttgaaaccttacgcggttgccctggttcctagaatattaacacggtttgaagccggtataaaaaatgctttggataaatcgactgtccagaggaacgtagcaaatactatattggattctaaatcggccagatttaccgcaagaggtggtccagataaatcgattatgaattttctagtttatcatcgcgtattgattgataaaatcagagactctttaggtttgtccaataactcgtttataattaccggatcagctcccatatctaaagataccttactatttttaagaagcgccttggatattggtataagacagggctacggcttaactgaaacttttgctggtgtctgtttaagcgaaccgtttgaaaaagatgtcggatcttgtggtgccataggtatttctgcagaatgtagattgaagtctgttccagaaatgggttaccatgccgacaaggatttaaaaggtgaactgcaaattcgtggcccacaggtttttgaaagatattttaaaaatccgaatgaaacttcaaaagccgttgaccaagatggttggttttccacgggagatgttgcatttatcgatgcaaaaggtcgcatcagcgtcattgatcgagtcaagaactttttcaagctagcacatggtgaatatattgctccagagaaaatcgaaaatatttatttatcatcatgcccctatatcacgcaaatatttgtctttggagatcctttgaagacatttttagttggcatcgttggtgttgatgttgatgcagcgcaaccgattttagctgcaaagcacccagaggtgaaaacgtggactaaggaagtgctagtagaaaacttaaatcgtaataaaaagctaaggaaggaatttttaaacaaaattaataaatgcatcgatgggctacaaggatttgaaaaattgcacaacatcaaagtcggacttgagcctttgactctcgaggatgatgttgtgacgccaacttttaaaataaagcgtgccaaagcatcaaaattcttcaaagatacattagaccaactatacgccgaaggttcactagtcaagacagaaaagctttag

SEQ ID NO: 169 - protein, 744 aa, Saccharomyces sp.
MAAPDYALTDLIESDPRFESLKTRLAGYTKGSDEYIEELYSQLPLTSYPRYKTFLKKQAVAISNPDNEAGFSSIYRSSLSSENLVSCVDKNLRTAYDHFMFSARRWPQRDCLGSRPIDKATGTWEETFRFESYSTVSKRCHNIGSGILSLVNTKRKRPLEANDFVVAILSHNNPEWILTDLACQAYSLTNTALYETLGPNTSEYILNLTEAPILIFAKSNMYHVLKMVPDMKFVNTLVCMDELTHDELRMLNESLLPVKCNSLNEKITFFSLEQVEQVGCFNKIPAIPPTPDSLYTISFTSGTTGLPKGVEMSHRNIASGIAFAFSTFRIPPDKRNQQLYDMCFLPLAHIFERMVIAYDLAIGFGIGFLHKPDPTVLVEDLKILKPYAVALVPRILTRFEAGIKNALDKSTVQRNVANTILDSKSARFTARGGPDKSIMNFLVYHRVLIDKIRDSLGLSNNSFIITGSAPISKDTLLFLRSALDIGIRQGYGLTETFAGVCLSEPFEKDVGSCGAIGISAECRLKSVPEMGYHADKDLKGELQIRGPQVFERYFKNPNETSKAVDQDGWFSTGDVAFIDAKGRISVIDRVKNFFKLAHGEYIAPEKIENIYLSSCPYITQIFVFGDPLKTFLVGIVGVDVDAAQPILAAKHPEVKTWTKEVLVENLNRNKKLRKEFLNKINKCIDGLQGFEKLHNIKVGLEPLTLEDDVVTPTFKIKRAKASKFFKDTLDQLYAEGSLVKTEKL

SEQ ID NO: 170 - DNA, 1113 bp, Artificial Sequence
  MBPtag
atgaaaatcgaagagggtaaattggtcatctggatcaatggtgacaaaggttacaacggtttggctgaagtcggtaaaaaattcgagaaagacactggtattaaggttaccgtcgaacacccagataagttggaagaaaaatttccacaagttgccgctactggtgatggtccagacatcattttctgggcccacgacagatttggtggttatgctcaatctggtttgttagccgagatcaccccagacaaagcctttcaagataaattatacccatttacctgggatgctgtccgttacaacggtaagttgatcgcttacccaatcgccgttgaagctttgtctttaatctacaataaagacttattgccaaaccctccaaagacctgggaagaaattcctgccttggataaggaattaaaggctaaaggtaaatctgccttaatgttcaacttacaagagccttactttacttggccattgattgctgctgatggtggttatgcttttaagtacgaaaatggtaaatacgacattaaagatgttggtgttgacaatgccggtgctaaagccggtttaactttcttagtcgacttgatcaagaacaagcacatgaatgctgacactgattattctatcgctgaagccgccttcaacaagggtgaaactgctatgactatcaatggtccttgggcctggtctaatattgacacctccaaagtcaactacggtgttactgtcttaccaactttcaaaggtcaaccttccaagccatttgtcggtgttttgtctgctggtattaacgctgcctctccaaacaaagaattggccaaggaatttttggaaaactacttgttgactgacgaaggtttagaggctgttaacaaagacaaaccattgggtgctgtcgccttgaaatcctacgaagaagaattagccaaggatccaagaatcgccgctaccatggaaaatgctcaaaaaggtgaaattatgccaaacattccacaaatgtccgctttttggtacgctgttagaactgctgttattaatgctgcttctggtagacaaactgtcgatgaagctttgaaggacgctcaaaccagaatcactaag

SEQ ID NO: 171 - DNA, 36 bp, Artificial Sequence
  GS12 Linker
ggaggtggaggaggtggttccggaggaggtggttct

SEQ ID NO: 172 - protein, 12 aa, Artificial Sequence
  GS12 Linker
GGGGGGSGGGGS

SEQ ID NO: 173 - DNA, 174 bp, Artificial Sequence
  GB1 tag
atgtctgacacttacaagttgatcttgaacggtaagactttgaaaggtgaaactactaccgaagctgttgatgctgccactgctgaaaaggtttttaagcaatacgccaatgataacggtgtcgacggtgaatggacttacgatgatgccactaagacttttaccgttactgaa

SEQ ID NO: 174 - protein, 58 aa, Artificial Sequence
  GB1 tag
MSDTYKLILNGKTLKGETTTEAVDAATAEKVFKQYANDNGVDGEWTYDDATKTFTVTE

SEQ ID NO: 175 - DNA, 57 bp, Artificial Sequence
  MFalpha1_1-19
atgagatttccttcaatttttactgcagttttattcgcagcatcctccgcattagct

SEQ ID NO: 176 - protein, 19 aa, Artificial Sequence
  MFalpha1_1-19
MRFPSIFTAVLFAASSALA

SEQ ID NO: 177 - DNA, 267 bp, Artificial Sequence
  MFalpha1_1-89
atgagatttccttcaatttttactgcagttttattcgcagcatcctccgcattagctgctccagtcaacactacaacagaagatgaaacggcacaaattccggctgaagctgtcatcggttacttagatttagaaggggatttcgatgttgctgttttgccattttccaacagcacaaataacgggttattgtttataaatactactattgccagcattgctgctaaagaagaaggggtatctttggataaaagagaggctgaagct

SEQ ID NO: 178 - protein, 89 aa, Artificial Sequence
  MFalpha1_1-89
MRFPSIFTAVLFAASSALAAPVNTTTEDETAQIPAEAVIGYLDLEGDFDVAVLPFSNSTNNGLLFINTTIASIAAKEEGVSLDKREAEA

SEQ ID NO: 179 - DNA, 714 bp, Artificial Sequence
  DasherGFP
atgaccgcactaacagaaggagctaaactattcgaaaaggagattccttacattacagaattagagggtgatgtcgaaggaatgaaattcattatcaagggcgagggtactggtgacgctactaccggtacgattaaagcaaagtacatctgtacaacaggtgaccttcctgttccgtgggctactctggtgagcactttgtcttatggagttcaatgttttgctaaatacccttcgcacattaaagactttttcaaaagtgcaatgcctgagggctatactcaggagagaacaatatctttcgaaggagatggtgtgtataagactagggctatggtcacgtatgaaagaggatccatctacaatagagtaactttaactggtgaaaacttcaaaaaggacggtcacatccttagaaagaatgttgcctttcaatgcccaccatccatcttgtacattttgccagacacagttaacaatggtatcagagttgagtttaaccaagcttatgacatagagggtgtcaccgaaaagttggttacaaaatgttcacagatgaatcgtcccctggcaggatcagctgccgtccatatcccacgttaccatcatatcacttatcataccaagctgtccaaagatcgtgatgagagaagggatcacatgtgtttggttgaagtggtaaaggccgtggatttggatacttaccaaggttga

SEQ ID NO: 180 - protein, 237 aa, Artificial Sequence
  DasherGFP
MTALTEGAKLFEKEIPYITELEGDVEGMKFIIKGEGTGDATTGTIKAKYICTTGDLPVPWATLVSTLSYGVQCFAKYPSHIKDFFKSAMPEGYTQERTISFEGDGVYKTRAMVTYERGSIYNRVTLTGENFKKDGHILRKNVAFQCPPSILYILPDTVNNGIRVEFNQAYDIEGVTEKLVTKCSQMNRPLAGSAAVHIPRYHHITYHTKLSKDRDERRDHMCLVEVVKAVDLDTYQG

SEQ ID NO: 181 - DNA, 87 bp, Artificial Sequence
  ER1 tag
atattagagcaacctctgaaatttgtgcttactgcggccgtcgtgctcttgacgacgtcggttctttgttgtgtagtatttacataa

SEQ ID NO: 182 - protein, 28 aa, Artificial Sequence
  ER1 tag
ILEQPLKFVLTAAVVLLTTSVLCCVVFT

SEQ ID NO: 183 - DNA, 96 bp, Artificial Sequence
  ER2 tag
tctacctctgaaaaccaaagtaaaggtagtggtacattggttgtcatattggccattttaatgctaggtgttgcttattatttgttgaacgaataa

SEQ ID NO: 184 - protein, 31 aa, Artificial Sequence
  ER2 tag
STSENQSKGSGTLVVILAILMLGVAYYLLNE

SEQ ID NO: 185 - DNA, 99 bp, Artificial Sequence
  PM1 tag
tggtacaaggatctaaaaatgaagatgtgtctggctttagtaatcatcatattgcttgttgtaatcatcgtccccattgctgttcactttagtcgataa

SEQ ID NO: 186 - protein, 32 aa, Artificial Sequence
  PM1 tag
WYKDLKMKMCLALVIIILLVVIIVPIAVHFSR

SEQ ID NO: 187 - DNA, 108 bp, Artificial Sequence
  VC1 tag
aatataaaagaaataatgtggtggcagaaggtcaaaaatattacgttattaactttcactattatactatttgtaagtgctgctttcatgtttttctatctgtggtaa

SEQ ID NO: 188 - protein, 35 aa, Artificial Sequence
  VC1 tag
NIKEIMWWQKVKNITLLTFTIILFVSAAFMFFYLW

SEQ ID NO: 189 - DNA, 12 bp, Artificial Sequence
  PEX8 tag
tctaaattataa

SEQ ID NO: 190 - protein, 3 aa, Artificial Sequence
  PEX8 tag
SKL

SEQ ID NO: 191 - DNA, 2103 bp, Saccharomyces cerevisiae
atggttgctcaatataccgttccagttgggaaagccgccaatgagcatgaaactgctccaagaagaaattatcaatgccgcgagaagccgctcgtcagaccgcctaacacaaagtgttccactgtttatgagtttgttctagagtgctttcagaagaacaaaaattcaaatgctatgggttggagggatgttaaggaaattcatgaagaatccaaatcggttatgaaaaaagttgatggcaaggagacttcagtggaaaagaaatggatgtattatgaactatcgcattatcattataattcatttgaccaattgaccgatatcatgcatgaaattggtcgtgggttggtgaaaataggattaaagcctaatgatgatgacaaattacatctttacgcagccacttctcacaagtggatgaagatgttcttaggagcgcagtctcaaggtattcctgtcgtcactgcctacgatactttgggagagaaagggctaattcattctttggtgcaaacggggtctaaggccatttttaccgataactctttattaccatccttgatcaaaccagtgcaagccgctcaagacgtaaaatacataattcatttcgattccatcagttctgaggacaggaggcaaagtggtaagatctatcaatctgctcatgatgccatcaacagaattaaagaagttagacctgatatcaagacctttagctttgacgacatcttgaagctaggtaaagaatcctgtaacgaaatcgatgttcatccacctggcaaggatgatctttgttgcatcatgtatacgtctggttctacaggtgagccaaagggtgttgtcttgaaacattcaaatgttgtcgcaggtgttggtggtgcaagtttgaatgttttgaagtttgtgggcaataccgaccgtgttatctgttttttgccactagctcatatttttgaattggttttcgaactattgtccttttattggggggcctgcattggttatgccaccgtaaaaactttaactagcagctctgtgagaaattgtcaaggtgatttgcaagaattcaagcccacaatcatggttggtgtcgccgctgtttgggaaacagtgagaaaagggatcttaaaccaaattgataatttgcccttcctcaccaagaaaatcttctggaccgcgtataataccaagttgaacatgcaacgtctccacatccctggtggcggcgccttaggaaacttggttttcaaaaaaatcagaactgccacaggtggccaattaagatatttgttaaacggtggttctccaatcagtcgggatgctcaggaattcatcacaaatttaatctgccctatgcttattggttacggtttaaccgagacatgcgctagtaccaccatcttggatcctgctaattttgaactcggcgtcgctggtgacctaacaggttgtgttaccgtcaaactagttgatgttgaagaattaggttattttgctaaaaacaaccaaggtgaagtttggatcacaggtgccaatgtcacgcctgaatattataagaatgaggaagaaacttctcaagctttaacaagcgatggttggttcaagaccggtgacatcggtgaatgggaagcaaatggccatttgaaaataattgacaggaagaaaaacttggtcaaaacaatgaacggtgaatatatcgcactcgagaaattagagtccgtttacagatctaacgaatatgttgctaacatttgtgtttatgccgaccaatctaagactaagccagttggtattattgtaccaaatcatgctccattaacgaagcttgctaaaaagttgggaattatggaacaaaaagacagttcaattaatatcgaaaattatttggaggatgcaaaattgattaaagctgtttattctgatcttttgaagacaggtaaagaccaaggtttggttggcattgaattactagcaggcatagtgttctttgacggcgaatggactccacaaaacggttttgttacgtccgctcagaaattgaaaagaaaagacattttgaatgctgtcaaagataaagttgacgccgtttatagttcgtcttaa

SEQ ID NO: 192 - protein, 700 aa, Saccharomyces cerevisiae
MVAQYTVPVGKAANEHETAPRRNYQCREKPLVRPPNTKCSTVYEFVLECFQKNKNSNAMGWRDVKEIHEESKSVMKKVDGKETSVEKKWMYYELSHYHYNSFDQLTDIMHEIGRGLVKIGLKPNDDDKLHLYAATSHKWMKMFLGAQSQGIPVVTAYDTLGEKGLIHSLVQTGSKAIFTDNSLLPSLIKPVQAAQDVKYIIHFDSISSEDRRQSGKIYQSAHDAINRIKEVRPDIKTFSFDDILKLGKESCNEIDVHPPGKDDLCCIMYTSGSTGEPKGVVLKHSNVVAGVGGASLNVLKFVGNTDRVICFLPLAHIFELVFELLSFYWGACIGYATVKTLTSSSVRNCQGDLQEFKPTIMVGVAAVWETVRKGILNQIDNLPFLTKKIFWTAYNTKLNMQRLHIPGGGALGNLVFKKIRTATGGQLRYLLNGGSPISRDAQEFITNLICPMLIGYGLTETCASTTILDPANFELGVAGDLTGCVTVKLVDVEELGYFAKNNQGEVWITGANVTPEYYKNEEETSQALTSDGWFKTGDIGEWEANGHLKIIDRKKNLVKTMNGEYIALEKLESVYRSNEYVANICVYADQSKTKPVGIIVPNHAPLTKLAKKLGIMEQKDSSINIENYLEDAKLIKAVYSDLLKTGKDQGLVGIELLAGIVFFDGEWTPQNGFVTSAQKLKRKDILNAVKDKVDAVYSSS

SEQ ID NO: 193 - DNA, 2226 bp, Artificial Sequence
  Truncated medium chain fatty acyl-CoA synthetase Sc_FAA2_Ctrunc
atggccgctccagattatgcacttaccgatttaattgaatcggatcctcgtttcgaaagtttgaagacaagattagccggttacaccaaaggctctgatgaatatattgaagagctatactctcaattaccactgaccagctaccccaggtacaaaacatttttaaagaaacaggcggttgccatttcgaatccggataatgaagctggttttagctcgatttataggagttctctttcttctgaaaatctagtgagctgtgtggataaaaacttaagaactgcatacgatcacttcatgttttctgcaaggagatggcctcaacgtgactgtttaggttcaaggccaattgataaagccacaggcacctgggaggaaacattccgtttcgagtcgtactccacggtatctaaaagatgtcataatatcggaagtggtatattgtctttggtaaacacgaaaaggaaacgtcctttggaagccaatgattttgttgttgctatcttatcacacaacaaccctgaatggatcctaacagatttggcctgtcaggcctattctctaactaacacggctttgtacgaaacattaggtccaaacacctccgagtacatattgaatttaaccgaggcccccattctgatttttgcaaaatcaaatatgtatcatgtattgaagatggtgcctgatatgaaatttgttaatactttggtttgtatggatgaattaactcatgacgagctccgtatgctaaatgaatcgttgctacccgttaagtgcaactctctcaatgaaaaaatcacatttttttcattggagcaggtagaacaagttggttgctttaacaaaattcctgcaattccacctaccccagattccttgtatactatttcgtttacttctggtactacaggtttacctaaaggtgtggaaatgtctcacagaaacattgcgtctgggatagcatttgctttttctaccttcagaataccgccagataaaagaaaccaacagttatatgatatgtgttttttgccattggctcatatttttgaaagaatggttattgcgtatgatctagccatcgggtttggaataggcttcttacataaaccagacccaactgtattggtagaggatttgaagattttgaaaccttacgcggttgccctggttcctagaatattaacacggtttgaagccggtataaaaaatgctttggataaatcgactgtccagaggaacgtagcaaatactatattggattctaaatcggccagatttaccgcaagaggtggtccagataaatcgattatgaattttctagtttatcatcgcgtattgattgataaaatcagagactctttaggtttgtccaataactcgtttataattaccggatcagctcccatatctaaagataccttactatttttaagaagcgccttggatattggtataagacagggctacggcttaactgaaacttttgctggtgtctgtttaagcgaaccgtttgaaaaagatgtcggatcttgtggtgccataggtatttctgcagaatgtagattgaagtctgttccagaaatgggttaccatgccgacaaggatttaaaaggtgaactgcaaattcgtggcccacaggtttttgaaagatattttaaaaatccgaatgaaacttcaaaagccgttgaccaagatggttggttttccacgggagatgttgcatttatcgatgcaaaaggtcgcatcagcgtcattgatcgagtcaagaactttttcaagctagcacatggtgaatatattgctccagagaaaatcgaaaatatttatttatcatcatgcccctatatcacgcaaatatttgtctttggagatcctttgaagacatttttagttggcatcgttggtgttgatgttgatgcagcgcaaccgattttagctgcaaagcacccagaggtgaaaacgtggactaaggaagtgctagtagaaaacttaaatcgtaataaaaagctaaggaaggaatttttaaacaaaattaataaatgcatcgatgggctacaaggatttgaaaaattgcacaacatcaaagtcggacttgagcctttgactctcgaggatgatgttgtgacgccaacttttaaaataaagcgtgccaaagcatcaaaattcttcaaagatacattagaccaactatacgccgaaggttcactagtcaagacatag

SEQ ID NO: 194 - protein, 741 aa, Artificial Sequence
  Truncated medium chain fatty acyl-CoA synthetase Sc_FAA2_Ctrunc
MAAPDYALTDLIESDPRFESLKTRLAGYTKGSDEYIEELYSQLPLTSYPRYKTFLKKQAVAISNPDNEAGFSSIYRSSLSSENLVSCVDKNLRTAYDHFMFSARRWPQRDCLGSRPIDKATGTWEETFRFESYSTVSKRCHNIGSGILSLVNTKRKRPLEANDFVVAILSHNNPEWILTDLACQAYSLTNTALYETLGPNTSEYILNLTEAPILIFAKSNMYHVLKMVPDMKFVNTLVCMDELTHDELRMLNESLLPVKCNSLNEKITFFSLEQVEQVGCFNKIPAIPPTPDSLYTISFTSGTTGLPKGVEMSHRNIASGIAFAFSTFRIPPDKRNQQLYDMCFLPLAHIFERMVIAYDLAIGFGIGFLHKPDPTVLVEDLKILKPYAVALVPRILTRFEAGIKNALDKSTVQRNVANTILDSKSARFTARGGPDKSIMNFLVYHRVLIDKIRDSLGLSNNSFIITGSAPISKDTLLFLRSALDIGIRQGYGLTETFAGVCLSEPFEKDVGSCGAIGISAECRLKSVPEMGYHADKDLKGELQIRGPQVFERYFKNPNETSKAVDQDGWFSTGDVAFIDAKGRISVIDRVKNFFKLAHGEYIAPEKIENIYLSSCPYITQIFVFGDPLKTFLVGIVGVDVDAAQPILAAKHPEVKTWTKEVLVENLNRNKKLRKEFLNKINKCIDGLQGFEKLHNIKVGLEPLTLEDDVVTPTFKIKRAKASKFFKDTLDQLYAEGSLVKT

SEQ ID NO: 195 - DNA, 2238 bp, Artificial Sequence
  Mutated medium chain fatty acyl-CoA synthetase Sc_FAA2_Cmut
atggccgctccagattatgcacttaccgatttaattgaatcggatcctcgtttcgaaagtttgaagacaagattagccggttacaccaaaggctctgatgaatatattgaagagctatactctcaattaccactgaccagctaccccaggtacaaaacatttttaaagaaacaggcggttgccatttcgaatccggataatgaagctggttttagctcgatttataggagttctctttcttctgaaaatctagtgagctgtgtggataaaaacttaagaactgcatacgatcacttcatgttttctgcaaggagatggcctcaacgtgactgtttaggttcaaggccaattgataaagccacaggcacctgggaggaaacattccgtttcgagtcgtactccacggtatctaaaagatgtcataatatcggaagtggtatattgtctttggtaaacacgaaaaggaaacgtcctttggaagccaatgattttgttgttgctatcttatcacacaacaaccctgaatggatcctaacagatttggcctgtcaggcctattctctaactaacacggctttgtacgaaacattaggtccaaacacctccgagtacatattgaatttaaccgaggcccccattctgatttttgcaaaatcaaatatgtatcatgtattgaagatggtgcctgatatgaaatttgttaatactttggtttgtatggatgaattaactcatgacgagctccgtatgctaaatgaatcgttgctacccgttaagtgcaactctctcaatgaaaaaatcacatttttttcattggagcaggtagaacaagttggttgctttaacaaaattcctgcaattccacctaccccagattccttgtatactatttcgtttacttctggtactacaggtttacctaaaggtgtggaaatgtctcacagaaacattgcgtctgggatagcatttgctttttctaccttcagaataccgccagataaaagaaaccaacagttatatgatatgtgttttttgccattggctcatatttttgaaagaatggttattgcgtatgatctagccatcgggtttggaataggcttcttacataaaccagacccaactgtattggtagaggatttgaagattttgaaaccttacgcggttgccctggttcctagaatattaacacggtttgaagccggtataaaaaatgctttggataaatcgactgtccagaggaacgtagcaaatactatattggattctaaatcggccagatttaccgcaagaggtggtccagataaatcgattatgaattttctagtttatcatcgcgtattgattgataaaatcagagactctttaggtttgtccaataactcgtttataattaccggatcagctcccatatctaaagataccttactatttttaagaagcgccttggatattggtataagacagggctacggcttaactgaaacttttgctggtgtctgtttaagcgaaccgtttgaaaaagatgtcggatcttgtggtgccataggtatttctgcagaatgtagattgaagtctgttccagaaatgggttaccatgccgacaaggatttaaaaggtgaactgcaaattcgtggcccacaggtttttgaaagatattttaaaaatccgaatgaaacttcaaaagccgttgaccaagatggttggttttccacgggagatgttgcatttatcgatgcaaaaggtcgcatcagcgtcattgatcgagtcaagaactttttcaagctagcacatggtgaatatattgctccagagaaaatcgaaaatatttatttatcatcatgcccctatatcacgcaaatatttgtctttggagatcctttgaagacatttttagttggcatcgttggtgttgatgttgatgcagcgcaaccgattttagctgcaaagcacccagaggtgaaaacgtggactaaggaagtgctagtagaaaacttaaatcgtaataaaaagctaaggaaggaatttttaaacaaaattaataaatgcatcgatgggctacaaggatttgaaaaattgcacaacatcaaagtcggacttgagcctttgactctcgaggatgatgttgtgacgccaacttttaaaataaagcgtgccaaagcatcaaaattcttcaaagatacattagaccaactatacgccgaaggttcactagtcaagacagaaaagcttaaatag

SEQ ID NO: 196 - protein, 745 aa, Artificial Sequence
  Mutated medium chain fatty acyl-CoA synthetase Sc_FAA2_Cmut
MAAPDYALTDLIESDPRFESLKTRLAGYTKGSDEYIEELYSQLPLTSYPRYKTFLKKQAVAISNPDNEAGFSSIYRSSLSSENLVSCVDKNLRTAYDHFMFSARRWPQRDCLGSRPIDKATGTWEETFRFESYSTVSKRCHNIGSGILSLVNTKRKRPLEANDFVVAILSHNNPEWILTDLACQAYSLTNTALYETLGPNTSEYILNLTEAPILIFAKSNMYHVLKMVPDMKFVNTLVCMDELTHDELRMLNESLLPVKCNSLNEKITFFSLEQVEQVGCFNKIPAIPPTPDSLYTISFTSGTTGLPKGVEMSHRNIASGIAFAFSTFRIPPDKRNQQLYDMCFLPLAHIFERMVIAYDLAIGFGIGFLHKPDPTVLVEDLKILKPYAVALVPRILTRFEAGIKNALDKSTVQRNVANTILDSKSARFTARGGPDKSIMNFLVYHRVLIDKIRDSLGLSNNSFIITGSAPISKDTLLFLRSALDIGIRQGYGLTETFAGVCLSEPFEKDVGSCGAIGISAECRLKSVPEMGYHADKDLKGELQIRGPQVFERYFKNPNETSKAVDQDGWFSTGDVAFIDAKGRISVIDRVKNFFKLAHGEYIAPEKIENIYLSSCPYITQIFVFGDPLKTFLVGIVGVDVDAAQPILAAKHPEVKTWTKEVLVENLNRNKKLRKEFLNKINKCIDGLQGFEKLHNIKVGLEPLTLEDDVVTPTFKIKRAKASKFFKDTLDQLYAEGSLVKTEKLK

SEQ ID NO: 197 - DNA, 2085 bp, Saccharomyces cerevisiae
atgtccgaacaacactctgtcgcagtcggtaaagctgctaatgagcacgagactgcccctaggagaaatgttagagtcaagaagcggcccttaattagaccattgaactcgtcagcatctacgctgtatgaatttgccctagagtgtttcaacaagggtggaaaacgagatggtatggcttggagagatgtcatcgagattcatgagacaaagaaaaccattgtgagaaaggtagacggcaaggataaatctatagaaaagacatggctgtattatgaaatgtcaccatataaaatgatgacctaccaggaactgatctgggtgatgcacgatatgggccgtgggctggcaaaaataggcatcaagcccaatggagaacacaaattccacatcttcgcatctacttcccataaatggatgaagattttccttggttgcatatcccagggtatccccgtagtaaccgcgtatgatactttgggtgagagcggtttgattcactccatggttgaaaccgagtctgctgctattttcactgataatcaattattggctaaaatgatagtgcctttgcaatctgctaaagatatcaaatttcttatccataacgaacctatcgaccccaatgacagaagacaaaacggcaaactttacaaggctgctaaggatgccattaataagatcagagaagttaggccagacataaaaatttatagttttgaagaagttgtcaagataggtaaaaaaagtaaagatgaggtcaaacttcatccacctgagccaaaagatttggcttgtatcatgtacacctcgggctcgatcagtgcaccaaaaggtgtagtattgactcattataatattgtttcgggtatcgctggtgtaggtcacaacgtctttggatggatcggctctacagaccgtgttttgtcgttcttgccattggctcatatttttgaactggtctttgaattcgaagccttttactggaacggtattcttgggtacggtagtgttaagactttgactaatacttcgactcgtaattgtaagggtgacctggttgagtttaagcctactattatgatcggtgtggctgccgtttgggaaactgtgagaaaagctattttggaaaagatcagcgatttaactcccgtactccaaaagattttttggtctgcctatagtatgaaagaaaagagtgtaccatgcaccgggtttttaagtcgtatggtcttcaagaaagtcagacaagccaccggtggtcatcttaagtatattatgaacggtgggtctgcgatcagtattgatgctcagaaattcttttctatcgtcctgtgtcctatgattatcggttacggccttactgaaacagttgcgaatgcttgtgttttggagcctgatcatttcgaatatggtatagttggtgatcttgttggatcggtcactgccaaattggtggatgttaaggacctaggttattatgcaaaaaacaatcaaggtgaattgcttctaaagggtgcgccggtctgttctgaatattataagaatccaatagaaacggcggtctctttcacttacgatggatggtttcgtactggtgatattgttgaatggactcccaagggacaacttaaaattattgatagaagaaagaatttggttaaaaccctaaatggtgaatatattgcattagaaaagttagaatctgtttacaggtcaaactcctatgtgaaaaatatctgtgtttatgccgatgaaagtagggttaaaccggtgggtattgtggtacccaacccaggacccctatctaaatttgctgtcaaattgcgtattatgaaaaagggtgaagacatcgaaaactatatccatgacaaagcattacgaaatgctgttttcaaagagatgatcgcaacagccaaatctcaaggtttggttggtattgaactattatgtggtattgttttctttgatgaagaatggacacctgaaaatggctttgtcacatctgctcaaaaattaaagagaagagaaatcttagccgctgttaaatcagaagtcgaaagggtttacaaagaaaattcttag

SEQ ID NO: 198 - protein, 694 aa, Saccharomyces cerevisiae
MSEQHSVAVGKAANEHETAPRRNVRVKKRPLIRPLNSSASTLYEFALECFNKGGKRDGMAWRDVIEIHETKKTIVRKVDGKDKSIEKTWLYYEMSPYKMMTYQELIWVMHDMGRGLAKIGIKPNGEHKFHIFASTSHKWMKIFLGCISQGIPVVTAYDTLGESGLIHSMVETESAAIFTDNQLLAKMIVPLQSAKDIKFLIHNEPIDPNDRRQNGKLYKAAKDAINKIREVRPDIKIYSFEEVVKIGKKSKDEVKLHPPEPKDLACIMYTSGSISAPKGVVLTHYNIVSGIAGVGHNVFGWIGSTDRVLSFLPLAHIFELVFEFEAFYWNGILGYGSVKTLTNTSTRNCKGDLVEFKPTIMIGVAAVWETVRKAILEKISDLTPVLQKIFWSAYSMKEKSVPCTGFLSRMVFKKVRQATGGHLKYIMNGGSAISIDAQKFFSIVLCPMIIGYGLTETVANACVLEPDHFEYGIVGDLVGSVTAKLVDVKDLGYYAKNNQGELLLKGAPVCSEYYKNPIETAVSFTYDGWFRTGDIVEWTPKGQLKIIDRRKNLVKTLNGEYIALEKLESVYRSNSYVKNICVYADESRVKPVGIVVPNPGPLSKFAVKLRIMKKGEDIENYIHDKALRNAVFKEMIATAKSQGLVGIELLCGIVFFDEEWTPENGFVTSAQKLKRREILAAVKSEVERVYKENS

SEQ ID NO: 199 - DNA, 2085 bp, Saccharomyces cerevisiae
atgaccgaacaatattccgttgcagttggcgaagccgacaatgagcatgaaaccgctccaagaagaaatatcagggttaaagacaagcctttgattagacccataaactcctcagcatctacactgtacgaattcgccctggaatgttttaccaaaggtggtaagagagacggtatggcatggagagatattatagatatacatgagacgaaaaaaaccatagtcaagagggtggatggtaaggataagcccatcgaaaaaacatggttgtactacgaactgactccctacataaccatgacatacgaggagatgatctgcgtaatgcacgacattggacgtgggctgataaagattggtgttaaacctaacggtgagaacaagttccacatctttgcctctacatctcacaagtggatgaaaacttttcttggttgcatgtcacaaggtattcctgtggtcaccgcgtacgacactttgggtgagagcggtttgattcactccatggtggaaacggattccgtcgccattttcacggacaaccagctgttgtccaaattagcagttcctttgaaaaccgccaagaacgtaaaattcgtcattcacaacgaacccatcgatccaagtgacaaaagacaaaatggtaagctttacaaggctgccaaggatgctgttgacaaaatcaaggaagttagaccggacataaaaatctacagtttcgatgaaattattgagataggtaaaaaggccaaggacgaggttgaattgcatttccccaagcctgaagatccagcttgtatcatgtacacttctggttccactggtacaccaaagggtgtggtattgacacattacaacattgtagctggtattggtggtgtgggccataacgttatcggatggattggcccaacagaccgtattatcgcattcttgccattggctcatatttttgaattaatctttgaattcgaagcgttctactggaatggtatcctagggtacgccactgtcaagactttaaccccaacttctacacgtaattgccaaggtgacctgatggagtttaaacctaccgtaatggtaggtgttgccgcagtttgggaaacagtgagaaaaggtatcctggccaagatcaacgaattgcccggttggtctcaaacgcttttctggactgtctatgctttgaaagagagaaatataccatgcagcggcttgctgagtgggttgatcttcaagagaatcagagaagcaaccggtggaaacttaaggtttattctgaacggtgggtctgcaatcagcatagacgcccaaaaattcctctccaaccttctatgtcctatgctcattggatatgggctaactgagggtgtggctaatgcctgtgtcctggagcctgaacattttgattacggtattgctggtgaccttgtcggaactattacagctaaattggtggatgtcgaagatttgggctattttgccaagaataaccaaggtgaattgctgttaaagggtgcacccatctgttctgaatactataagaatcctgaagaaactgctgcggcctttaccgatgatggctggttccgtaccggtgatatcgctgaatggacccccaagggacaaattaagatcattgatagaaagaaaaatttggtcaagaccttaaacggtgagtacattgcattggaaaaattagaatccatttacagatcaaatccttacgtccaaaacatctgtgtctacgctgatgaaaacaaagttaagcctgtcggtattgtggtccctaacttaggacacttgtctaagctggctatcgaattaggtataatggtaccaggtgaagatgtcgaaagctatatccatgaaaagaagctacaggatgccgtttgcaaagatatgctgtcaactgccaaatctcaaggcttgaatggtattgaattattatgtggcattgttttctttgaagaagaatggactccagaaaacggtcttgttacatccgcccaaaaattaaagagaagagatattctagcggctgtcaagccagatgtggaaagagtttataaagaaaacacttaa

SEQ ID NO: 200 - protein, 694 aa, Saccharomyces cerevisiae
MTEQYSVAVGEADNEHETAPRRNIRVKDKPLIRPINSSASTLYEFALECFTKGGKRDGMAWRDIIDIHETKKTIVKRVDGKDKPIEKTWLYYELTPYITMTYEEMICVMHDIGRGLIKIGVKPNGENKFHIFASTSHKWMKTFLGCMSQGIPVVTAYDTLGESGLIHSMVETDSVAIFTDNQLLSKLAVPLKTAKNVKFVIHNEPIDPSDKRQNGKLYKAAKDAVDKIKEVRPDIKIYSFDEIIEIGKKAKDEVELHFPKPEDPACIMYTSGSTGTPKGVVLTHYNIVAGIGGVGHNVIGWIGPTDRIIAFLPLAHIFELIFEFEAFYWNGILGYATVKTLTPTSTRNCQGDLMEFKPTVMVGVAAVWETVRKGILAKINELPGWSQTLFWTVYALKERNIPCSGLLSGLIFKRIREATGGNLRFILNGGSAISIDAQKFLSNLLCPMLIGYGLTEGVANACVLEPEHFDYGIAGDLVGTITAKLVDVEDLGYFAKNNQGELLLKGAPICSEYYKNPEETAAAFTDDGWFRTGDIAEWTPKGQIKIIDRKKNLVKTLNGEYIALEKLESIYRSNPYVQNICVYADENKVKPVGIVVPNLGHLSKLAIELGIMVPGEDVESYIHEKKLQDAVCKDMLSTAKSQGLNGIELLCGIVFFEEEWTPENGLVTSAQKLKRRDILAAVKPDVERVYKENT

SEQ ID NO: 201 - DNA, 6702 bp, Artificial Sequence
  Mutated acetyl-CoA carboxylase (ACC1) (S659A, S1157A)
atgagcgaagaaagcttattcgagtcttctccacagaagatggagtacgaaattacaaactactcagaaagacatacagaacttccaggtcatttcattggcctcaatacagtagataaactagaggagtccccgttaagggactttgttaagagtcacggtggtcacacggtcatatccaagatcctgatagcaaataatggtattgccgccgtgaaagaaattagatccgtcagaaaatgggcatacgagacgttcggcgatgacagaaccgtccaattcgtcgccatggccaccccagaagatctggaggccaacgcagaatatatccgtatggccgatcaatacattgaagtgccaggtggtactaataataacaactacgctaacgtagacttgatcgtagacatcgccgaaagagcagacgtagacgccgtatgggctggctggggtcacgcctccgagaatccactattgcctgaaaaattgtcccagtctaagaggaaagtcatctttattgggcctccaggtaacgccatgaggtctttaggtgataaaatctcctctaccattgtcgctcaaagtgctaaagtcccatgtattccatggtctggtaccggtgttgacaccgttcacgtggacgagaaaaccggtctggtctctgtcgacgatgacatctatcaaaagggttgttgtacctctcctgaagatggtttacaaaaggccaagcgtattggttttcctgtcatgattaaggcatccgaaggtggtggtggtaaaggtatcagacaagttgaacgtgaagaagatttcatcgctttataccaccaggcagccaacgaaattccaggctcccccattttcatcatgaagttggccggtagagcgcgtcacttggaagttcaactgctagcagatcagtacggtacaaatatttccttgttcggtagagactgttccgttcagagacgtcatcaaaaaattatcgaagaagcaccagttacaattgccaaggctgaaacatttcacgagatggaaaaggctgccgtcagactggggaaactagtcggttatgtctctgccggtaccgtggagtatctatattctcatgatgatggaaaattctactttttagaattgaacccaagattacaagtcgagcatccaacaacggaaatggtctccggtgttaacttacctgcagctcaattacaaatcgctatgggtatccctatgcatagaataagtgacattagaactttatatggtatgaatcctcattctgcctcagaaatcgatttcgaattcaaaactcaagatgccaccaagaaacaaagaagacctattccaaagggtcattgtaccgcttgtcgtatcacatcagaagatccaaacgatggattcaagccatcgggtggtactttgcatgaactaaacttccgttcttcctctaatgtttggggttacttctccgtgggtaacaatggtaatattcactccttttcggactctcagttcggccatatttttgcttttggtgaaaatagacaagcttccaggaaacacatggttgttgccctgaaggaattgtccattaggggtgatttcagaactactgtggaatacttgatcaaacttttggaaactgaagatttcgaggataacactattaccaccggttggttggacgatttgattactcataaaatgaccgctgaaaagcctgatccaactcttgccgtcatttgcggtgccgctacaaaggctttcttagcatctgaagaagcccgccacaagtatatcgaatccttacaaaagggacaagttctatctaaagacctactgcaaactatgttccctgtagattttatccatgagggtaaaagatacaagttcaccgtagctaaatccggtaatgaccgttacacattatttatcaatggttctaaatgtgatatcatactgcgtcaactatctgatggtggtcttttgattgccataggcggtaaatcgcataccatctattggaaagaagaagttgctgctacaagattatccgttgactctatgactactttgttggaagttgaaaacgatccaacccagttgcgtactccatcccctggtaaattggttaaattcttggtggaaaatggtgaacacattatcaagggccaaccatatgcagaaattgaagttatgaaaatgcaaatgcctttggtttctcaagaaaatggtatcgtccagttattaaagcaacctggttctaccattgttgcaggtgatatcatggctattatgactcttgacgatccatccaaggtcaagcacgctctaccatttgaaggtatgctgccagattttggttctccagttatcgaaggaaccaaacctgcctataaattcaagtcattagtgtctactttggaaaacattttgaagggttatgacaaccaagttattatgaacgcttccttgcaacaattgatagaggttttgagaaatccaaaactgccttactcagaatggaaactacacatctctgctttacattcaagattgcctgctaagctagatgaacaaatggaagagttagttgcacgttctttgagacgtggtgctgttttcccagctagacaattaagtaaattgattgatatggccgtgaagaatcctgaatacaaccccgacaaattgctgggcgccgtcgtggaaccattggcggatattgctcataagtactctaacgggttagaagcccatgaacattctatatttgtccatttcttggaagaatattacgaagttgaaaagttattcaatggtccaaatgttcgtgaggaaaatatcattctgaaattgcgtgatgaaaaccctaaagatctagataaagttgcgctaactgttttgtctcattcgaaagtttcagcgaagaataacctgatcctagctatcttgaaacattatcaaccattgtgcaagttatcttctaaagtttctgccattttctctactcctctacaacatattgttgaactagaatctaaggctaccgctaaggtcgctctacaagcaagagaaattttgattcaaggcgctttaccttcggtcaaggaaagaactgaacaaattgaacatatcttaaaatcctctgttgtgaaggttgcctatggctcatccaatccaaagcgctctgaaccagatttgaatatcttgaaggacttgatcgattctaattacgttgtgttcgatgttttacttcaattcctaacccatcaagacccagttgtgactgctgcagctgctcaagtctatattcgtcgtgcttatcgtgcttacaccataggagatattagagttcacgaaggtgtcacagttccaattgttgaatggaaattccaactaccttcagctgcgttctccacctttccaactgttaaatctaaaatgggtatgaacagggctgtttctgtttcagatttgtcatatgttgcaaacagtcagtcatctccgttaagagaaggtattttgatggctgtggatcatttagatgatgttgatgaaattttgtcacaaagtttggaagttattcctcgtcaccaatcttcttctaacggacctgctcctgatcgttctggtagctccgcatcgttgagtaatgttgctaatgtttgtgttgcttctacagaaggtttcgaatctgaagaggaaattttggtaaggttgagagaaattttggatttgaataagcaggaattaatcaatgcttctatccgtcgtatcacatttatgttcggttttaaagatgggtcttatccaaagtattatacttttaacggtccaaattataacgaaaatgaaacaattcgtcacattgagccggctttggccttccaactggaattaggaagattgtccaacttcaacattaaaccaattttcactgataatagaaacatccatgtctacgaagctgttagtaagacttctccattggataagagattctttacaagaggtattattagaacgggtcatatccgtgatgacatttctattcaagaatatctgacttctgaagctaacagattgatgagtgatatattggataatttagaagtcaccgacacttcaaattctgatttgaatcatatcttcatcaacttcattgcggtgtttgatatctctccagaagatgtcgaagccgccttcggtggtttcttagaaagatttggtaagagattgttgagattgcgtgtttcttctgccgaaattagaatcatcatcaaagatcctcaaacaggtgccccagtaccattgcgtgccttgatcaataacgtttctggttatgttatcaaaacagaaatgtacaccgaagtcaagaacgcaaaaggtgaatgggtatttaagtctttgggtaaacctggatccatgcatttaagacctattgctactccttaccctgttaaggaatggttgcaaccaaaacgttataaggcacacttgatgggtaccacatatgtctatgacttcccagaattattccgccaagcatcgtcatcccaatggaaaaatttctctgcagatgttaagttaacagatgatttctttatttccaacgagttgattgaagatgaaaacggcgaattaactgaggtggaaagagaacctggtgccaacgctattggtatggttgcctttaagattactgtaaagactcctgaatatccaagaggccgtcaatttgttgttgttgctaacgatatcacattcaagatcggttcctttggtccacaagaagacgaattcttcaataaggttactgaatatgctagaaagcgtggtatcccaagaatttacttggctgcaaactcaggtgccagaattggtatggctgaagagattgttccactatttcaagttgcatggaatgatgctgccaatccggacaagggcttccaatacttatacttaacaagtgaaggtatggaaactttaaagaaatttgacaaagaaaattctgttctcactgaacgtactgttataaacggtgaagaaagatttgtcatcaagacaattattggttctgaagatgggttaggtgtcgaatgtctacgtggatctggtttaattgctggtgcaacgtcaagggcttaccacgatatcttcactatcaccttagtcacttgtagatccgtcggtatcggtgcttatttggttcgtttgggtcaaagagctattcaggtcgaaggccagccaattattttaactggtgctcctgcaatcaacaaaatgctgggtagagaagtttatacttctaacttacaattgggtggtactcaaatcatgtataacaacggtgtttcacatttgactgctgttgacgatttagctggtgtagagaagattgttgaatggatgtcttatgttccagccaagcgtaatatgccagttcctatcttggaaactaaagacacatgggatagaccagttgatttcactccaactaatgatgaaacttacgatgtaagatggatgattgaaggtcgtgagactgaaagtggatttgaatatggtttgtttgataaagggtctttctttgaaactttgtcaggatgggccaaaggtgttgtcgttggtagagcccgtcttggtggtattccactgggtgttattggtgttgaaacaagaactgtcgagaacttgattcctgctgatccagctaatccaaatagtgctgaaacattaattcaagaacctggtcaagtttggcatccaaactccgccttcaagactgctcaagctatcaatgactttaacaacggtgaacaattgccaatgatgattttggccaactggagaggtttctctggtggtcaacgtgatatgttcaacgaagtcttgaagtatggttcgtttattgttgacgcattggtggattacaaacaaccaattattatctatatcccacctaccggtgaactaagaggtggttcatgggttgttgtcgatccaactatcaacgctgaccaaatggaaatgtatgccgacgtcaacgctagagctggtgttttggaaccacaaggtatggttggtatcaagttccgtagagaaaaattgctggacaccatgaacagattggatgacaagtacagagaattgagatctcaattatccaacaagagtttggctccagaagtacatcagcaaatatccaagcaattagctgatcgtgagagagaactattgccaatttacggacaaatcagtcttcaatttgctgatttgcacgataggtcttcacgtatggtggccaagggtgttatttctaaggaactggaatggaccgaggcacgtcgtttcttcttctggagattgagaagaagattgaacgaagaatatttgattaaaaggttgagccatcaggtaggcgaagcatcaagattagaaaagatcgcaagaattagatcgtggtaccctgcttcagtggaccatgaagatgataggcaagtcgcaacatggattgaagaaaactacaaaactttggacgataaactaaagggtttgaaattagagtcattcgctcaagacttagctaaaaagatcagaagcgaccatgacaatgctattgatggattatctgaagttatcaagatgttatctaccgatgataaagaaaaattgttgaagactttgaaataa

SEQ ID NO: 202 - DNA, 894 bp, Artificial Sequence
  Truncated geranylgeranyl pyrophosphate synthase Ag_GPPS_Ntrunc
atgtcttttgacttcaataagtatatggattctaaggctatgaccgtcaacgaggctttgaataaagccatcccattgcgttacccacaaaagatctacgaatctatgagatattctttgttagctggtggtaagagagtccgtccagttttgtgtatcgccgcttgtgaattagtcggtggtactgaggagttagctattccaaccgcctgtgccatcgaaatgatccacaccatgtctttgatgcacgatgatttgccatgtatcgacaacgatgacttgagacgtggtaaacctaccaatcataagattttcggtgaagatactgctgttactgccggtaacgctttacactcttacgccttcgaacatattgctgtttctacttccaagactgttggtgctgatagaattttgagaatggtttctgaattaggtcgtgctactggttccgaaggtgttatgggtggtcaaatggtcgatattgcttctgaaggtgacccttccattgatttgcaaactttagaatggatccacatccacaagactgctatgttattagaatgttctgttgtctgtggtgccatcatcggtggtgcttctgaaattgttattgagagagccagacgttatgctcgttgtgtcggtttattgtttcaagttgttgacgacattttagatgttaccaaatcttctgacgaattgggtaaaactgctggtaaagatttaatctccgataaagccacctaccctaagttgatgggtttggagaaggccaaagagttttccgatgaattattaaacagagctaaaggtgaattgtcttgcttcgatccagttaaggctgccccattgttaggtttggctgactacgttgccttcagacaaaactaa

SEQ ID NO: 203 - protein, 297 aa, Artificial Sequence
  Truncated geranylgeranyl pyrophosphate synthase Ag_GPPS_Ntrunc
MSFDFNKYMDSKAMTVNEALNKAIPLRYPQKIYESMRYSLLAGGKRVRPVLCIAACELVGGTEELAIPTACAIEMIHTMSLMHDDLPCIDNDDLRRGKPTNHKIFGEDTAVTAGNALHSYAFEHIAVSTSKTVGADRILRMVSELGRATGSEGVMGGQMVDIASEGDPSIDLQTLEWIHIHKTAMLLECSVVCGAIIGGASEIVIERARRYARCVGLLFQVVDDILDVTKSSDELGKTAGKDLISDKATYPKLMGLEKAKEFSDELLNRAKGELSCFDPVKAAPLLGLADYVAFRQN

SEQ ID NO: 204 - DNA, 1356 bp, Saccharomyces cerevisiae
ttatttatcaagataagtttccggatctttttctttcctaacaccccagtcagcctgagttacatccagccattgaaccttagaaaatcttttgtcatcagcggtttgagccctaagatcaacatcttgcttagcaatcactgcaatggcgtcataaccaccagcaccaggtattaagcaagtaagaactccttttaaggtctggcaatcatccaataagctagtttgtacgggaggttcgatatcggcaccagattctttagttatttttctaaaggaacgtctaattgtggcaactgcatctctaacttctgtgatctcaggatacttttgacaggtacagtcattcctctcaagagactcaaatatctgatcgctgtaatcgtcatgagtctcgtgtaagcgatctagtttagatagtccatccataaatctagaatttgcatgatcgagttctgtatatattttcaagctttccggcatatgcgaatcataccaattttttaccttctggaccagttttactgtttctgaaccattcttaatatcgcccatccataaagttaatcccgaaggtaaatggttacttttaatcgttatattccagtcttcttcattaaccaaatgcgccagtttactgccgtaagtagcacttccaatatctggcaaattagagattaatgcgggtgggaatcttctatatctgatagatccatatgctgccgccgctacatcaaacccgcttccaattttaccctgagcttgacaatgagcaacttgtgataaattatgaataacttctctatatttgtctacattattttccaggtccgatacaaaaaaggaggccaaagctgtagttaaaactgtgactaaacctgccgaggagcccagccctgttttgggaacttcttcaattctgtgcgaatgaaaactcaatcttctgttgccacgatgttcggtaacgctgtcctcctgagaatggtaggcatcatcagagaaaatatcaataacgaacaagtttctattgcagtagtcgtccatgttaggcttaaagtagctaaatacgttagcgataactttttcaatgaaagggttcttagatccgcctatcgaaacaggaatgaagccagttttaggacttatatggtacagccactccccatctttaaattgtttacttttcacacgcacttcaaacttatcagactcttgcaatgaaccgtaaggatgggctacagcatgcattcttgccgataatccgactacaaatgcttcatatttcggatctaaaactaaatatccaccagctagtaacgctttccctggggcactgaaggctctcaactctgacat

SEQ ID NO: 205 - protein, 451 aa, Saccharomyces cerevisiae
MSELRAFSAPGKALLAGGYLVLDPKYEAFVVGLSARMHAVAHPYGSLQESDKFEVRVKSKQFKDGEWLYHISPKTGFIPVSIGGSKNPFIEKVIANVFSYFKPNMDDYCNRNLFVIDIFSDDAYHSQEDSVTEHRGNRRLSFHSHRIEEVPKTGLGSSAGLVTVLTTALASFFVSDLENNVDKYREVIHNLSQVAHCQAQGKIGSGFDVAAAAYGSIRYRRFPPALISNLPDIGSATYGSKLAHLVNEEDWNITIKSNHLPSGLTLWMGDIKNGSETVKLVQKVKNWYDSHMPESLKIYTELDHANSRFMDGLSKLDRLHETHDDYSDQIFESLERNDCTCQKYPEITEVRDAVATIRRSFRKITKESGADIEPPVQTSLLDDCQTLKGVLTCLIPGAGGYDAIAVIAKQDVDLRAQTADDKRFSKVQWLDVTQADWGVRKEKDPETYLDK

SEQ ID NO: 206 - DNA, 1332 bp, Saccharomyces cerevisiae
atgtcattaccgttcttaacttctgcaccgggaaaggttattatttttggtgaacactctgctgtgtacaacaagcctgccgtcgctgctagtgtgtctgcgttgagaacctacctgctaataagcgagtcatctgcaccagatactattgaattggacttcccggacattagctttaatcataagtggtccatcaatgatttcaatgccatcaccgaggatcaagtaaactcccaaaaattggccaaggctcaacaagccaccgatggcttgtctcaggaactcgttagtcttttggatccgttgttagctcaactatccgaatccttccactaccatgcagcgttttgtttcctgtatatgtttgtttgcctatgcccccatgccaagaatattaagttttctttaaagtctactttacccatcggtgctgggttgggctcaagcgcctctatttctgtatcactggccttagctatggcctacttgggggggttaataggatctaatgacttggaaaagctgtcagaaaacgataagcatatagtgaatcaatgggccttcataggtgaaaagtgtattcacggtaccccttcaggaatagataacgctgtggccacttatggtaatgccctgctatttgaaaaagactcacataatggaacaataaacacaaacaattttaagttcttagatgatttcccagccattccaatgatcctaacctatactagaattccaaggtctacaaaagatcttgttgctcgcgttcgtgtgttggtcaccgagaaatttcctgaagttatgaagccaattctagatgccatgggtgaatgtgccctacaaggcttagagatcatgactaagttaagtaaatgtaaaggcaccgatgacgaggctgtagaaactaataatgaactgtatgaacaactattggaattgataagaataaatcatggactgcttgtctcaatcggtgtttctcatcctggattagaacttattaaaaatctgagcgatgatttgagaattggctccacaaaacttaccggtgctggtggcggcggttgctctttgactttgttacgaagagacattactcaagagcaaattgacagtttcaaaaagaaattgcaagatgattttagttacgagacatttgaaacagacttgggtgggactggctgctgtttgttaagcgcaaaaaatttgaataaagatcttaaaatcaaatccctagtattccaattatttgaaaataaaactaccacaaagcaacaaattgacgatctattattgccaggaaacacgaatttaccatggacttcataa

SEQ ID NO: 207 - protein, 2233 aa, Artificial Sequence
  Mutated acetyl-CoA carboxylase (ACC1) (S659A, S1157A)
MSEESLFESSPQKMEYEITNYSERHTELPGHFIGLNTVDKLEESPLRDFVKSHGGHTVISKILIANNGIAAVKEIRSVRKWAYETFGDDRTVQFVAMATPEDLEANAEYIRMADQYIEVPGGTNNNNYANVDLIVDIAERADVDAVWAGWGHASENPLLPEKLSQSKRKVIFIGPPGNAMRSLGDKISSTIVAQSAKVPCIPWSGTGVDTVHVDEKTGLVSVDDDIYQKGCCTSPEDGLQKAKRIGFPVMIKASEGGGGKGIRQVEREEDFIALYHQAANEIPGSPIFIMKLAGRARHLEVQLLADQYGTNISLFGRDCSVQRRHQKIIEEAPVTIAKAETFHEMEKAAVRLGKLVGYVSAGTVEYLYSHDDGKFYFLELNPRLQVEHPTTEMVSGVNLPAAQLQIAMGIPMHRISDIRTLYGMNPHSASEIDFEFKTQDATKKQRRPIPKGHCTACRITSEDPNDGFKPSGGTLHELNFRSSSNVWGYFSVGNNGNIHSFSDSQFGHIFAFGENRQASRKHMVVALKELSIRGDFRTTVEYLIKLLETEDFEDNTITTGWLDDLITHKMTAEKPDPTLAVICGAATKAFLASEEARHKYIESLQKGQVLSKDLLQTMFPVDFIHEGKRYKFTVAKSGNDRYTLFINGSKCDIILRQLSDGGLLIAIGGKSHTIYWKEEVAATRLSVDSMTTLLEVENDPTQLRTPSPGKLVKFLVENGEHIIKGQPYAEIEVMKMQMPLVSQENGIVQLLKQPGSTIVAGDIMAIMTLDDPSKVKHALPFEGMLPDFGSPVIEGTKPAYKFKSLVSTLENILKGYDNQVIMNASLQQLIEVLRNPKLPYSEWKLHISALHSRLPAKLDEQMEELVARSLRRGAVFPARQLSKLIDMAVKNPEYNPDKLLGAVVEPLADIAHKYSNGLEAHEHSIFVHFLEEYYEVEKLFNGPNVREENIILKLRDENPKDLDKVALTVLSHSKVSAKNNLILAILKHYQPLCKLSSKVSAIFSTPLQHIVELESKATAKVALQAREILIQGALPSVKERTEQIEHILKSSVVKVAYGSSNPKRSEPDLNILKDLIDSNYVVFDVLLQFLTHQDPVVTAAAAQVYIRRAYRAYTIGDIRVHEGVTVPIVEWKFQLPSAAFSTFPTVKSKMGMNRAVSVSDLSYVANSQSSPLREGILMAVDHLDDVDEILSQSLEVIPRHQSSSNGPAPDRSGSSASLSNVANVCVASTEGFESEEEILVRLREILDLNKQELINASIRRITFMFGFKDGSYPKYYTFNGPNYNENETIRHIEPALAFQLELGRLSNFNIKPIFTDNRNIHVYEAVSKTSPLDKRFFTRGIIRTGHIRDDISIQEYLTSEANRLMSDILDNLEVTDTSNSDLNHIFINFIAVFDISPEDVEAAFGGFLERFGKRLLRLRVSSAEIRIIIKDPQTGAPVPLRALINNVSGYVIKTEMYTEVKNAKGEWVFKSLGKPGSMHLRPIATPYPVKEWLQPKRYKAHLMGTTYVYDFPELFRQASSSQWKNFSADVKLTDDFFISNELIEDENGELTEVEREPGANAIGMVAFKITVKTPEYPRGRQFVVVANDITFKIGSFGPQEDEFFNKVTEYARKRGIPRIYLAANSGARIGMAEEIVPLFQVAWNDAANPDKGFQYLYLTSEGMETLKKFDKENSVLTERTVINGEERFVIKTIIGSEDGLGVECLRGSGLIAGATSRAYHDIFTITLVTCRSVGIGAYLVRLGQRAIQVEGQPIILTGAPAINKMLGREVYTSNLQLGGTQIMYNNGVSHLTAVDDLAGVEKIVEWMSYVPAKRNMPVPILETKDTWDRPVDFTPTNDETYDVRWMIEGRETESGFEYGLFDKGSFFETLSGWAKGVVVGRARLGGIPLGVIGVETRTVENLIPADPANPNSAETLIQEPGQVWHPNSAFKTAQAINDFNNGEQLPMMILANWRGFSGGQRDMFNEVLKYGSFIVDALVDYKQPIIIYIPPTGELRGGSWVVVDPTINADQMEMYADVNARAGVLEPQGMVGIKFRREKLLDTMNRLDDKYRELRSQLSNKSLAPEVHQQISKQLADRERELLPIYGQISLQFADLHDRSSRMVAKGVISKELEWTEARRFFFWRLRRRLNEEYLIKRLSHQVGEASRLEKIARIRSWYPASVDHEDDRQVATWIEENYKTLDDKLKGLKLESFAQDLAKKIRSDHDNAIDGLSEVIKMLSTDDKEKLLKTLK

SEQ ID NO: 208 - protein, 524 aa, Artificial Sequence
  Truncated 3-hydroxy-3-methyl-glutaryl-CoA reductase (Sc_tHMG1)
MQLVKTEVTKKSFTAPVQKASTPVLTNKTVISGSKVKSLSSAQSSSSGPSSSSEEDDSRDIESLDKKIRPLEELEALLSSGNTKQLKNKEVAALVIHGKLPLYALEKKLGDTTRAVAVRRKALSILAEAPVLASDRLPYKNYDYDRVFGACCENVIGYMPLPVGVIGPLVIDGTSYHIPMATTEGCLVASAMRGCKAINAGGGATTVLTKDGMTRGPVVRFPTLKRSGACKIWLDSEEGQNAIKKAFNSTSRFARLQHIQTCLAGDLLFMRFRTTTGDAMGMNMISKGVEYSLKQMVEEYGWEDMEVVSVSGNYCTDKKPAAINWIEGRGKSVVAEATIPGDVVRKVLKSDVSALVELNIAKNLVGSAMAGSVGGFNAHAANLVTAVFLALGQDPAQNVESSNCITLMKEVDGDLRISVSMPSIEVGTIGGGTVLEPQGAMLDLLGVRGPHATAPGTNARQLARIVACAVLAGELSLCAALAAGHLVQSHMTHNRKPAEPTKPNNLDATDINRLKDGSVTCIKS

SEQ ID NO: 209 - DNA, 1197 bp, Saccharomyces cerevisiae
atgtctcagaacgtttacattgtatcgactgccagaaccccaattggttcattccagggttctctatcctccaagacagcagtggaattgggtgctgttgctttaaaaggcgccttggctaaggttccagaattggatgcatccaaggattttgacgaaattatttttggtaacgttctttctgccaatttgggccaagctccggccagacaagttgctttggctgccggtttgagtaatcatatcgttgcaagcacagttaacaaggtctgtgcatccgctatgaaggcaatcattttgggtgctcaatccatcaaatgtggtaatgctgatgttgtcgtagctggtggttgtgaatctatgactaacgcaccatactacatgccagcagcccgtgcgggtgccaaatttggccaaactgttcttgttgatggtgtcgaaagagatgggttgaacgatgcgtacgatggtctagccatgggtgtacacgcagaaaagtgtgcccgtgattgggatattactagagaacaacaagacaattttgccatcgaatcctaccaaaaatctcaaaaatctcaaaaggaaggtaaattcgacaatgaaattgtacctgttaccattaagggatttagaggtaagcctgatactcaagtcacgaaggacgaggaacctgctagattacacgttgaaaaattgagatctgcaaggactgttttccaaaaagaaaacggtactgttactgccgctaacgcttctccaatcaacgatggtgctgcagccgtcatcttggtttccgaaaaagttttgaaggaaaagaatttgaagcctttggctattatcaaaggttggggtgaggccgctcatcaaccagctgattttacatgggctccatctcttgcagttccaaaggctttgaaacatgctggcatcgaagacatcaattctgttgattactttgaattcaatgaagccttttcggttgtcggtttggtgaacactaagattttgaagctagacccatctaaggttaatgtatatggtggtgctgttgctctaggtcacccattgggttgttctggtgctagagtggttgttacactgctatccatcttacagcaagaaggaggtaagatcggtgttgccgccatttgtaatggtggtggtggtgcttcctctattgtcattgaaaagatatga

SEQ ID NO: 210 - DNA, 867 bp, Artificial Sequence
  Artificial truncated geranyl pyrophosphate olivetolic acid geranyltransferase CsPT4_t112
atgtcttacgttgtcaagggtatgatctctattgcttgtggtttgttcggtagagaattgtttaacaacagacacttgttctcttggggtttgatgtggaaagctttcttcgctttggtcccaattttgtctttcaatttcttcgccgccatcatgaaccaaatctacgatgttgatatcgaccgtatcaacaagccagacttacctttagtttccggtgaaatgtccattgaaactgcttggatcttgtctatcattgttgccttgactggtttaattgttactattaagttgaagtccgctccattgtttgtcttcatctacatcttcggtatcttcgctggtttcgcttactccgtcccacctattagatggaaacaatatccttttaccaatttcttgatcactatttcctctcatgttggtttggctttcacttcttactctgccaccacttctgctttaggtttgcctttcgtttggcgtcctgccttctctttcattattgctttcatgactgtcatgggtatgactattgcctttgctaaagacatttctgatatcgaaggtgatgctaagtacggtgtctctaccgttgctaccaagttaggtgctagaaatatgacttttgttgtttctggtgtcttattgttgaactacttggtttctatctctattggtatcatttggccacaagttttcaagtctaacattatgatcttgtctcatgctattttggctttctgtttgatctttcaaactcgtgaattagccttagccaattatgcctctgccccatcccgtcaatttttcgaattcatctggttgttatactatgccgaatacttcgtttacgtcttcatttaa

SEQ ID NO: 211 - protein, 288 aa, Artificial Sequence
  Truncated geranyl pyrophosphate olivetolic acid geranyltransferase CsPT4_t112
MSYVVKGMISIACGLFGRELFNNRHLFSWGLMWKAFFALVPILSFNFFAAIMNQIYDVDIDRINKPDLPLVSGEMSIETAWILSIIVALTGLIVTIKLKSAPLFVFIYIFGIFAGFAYSVPPIRWKQYPFTNFLITISSHVGLAFTSYSATTSALGLPFVWRPAFSFIIAFMTVMGMTIAFAKDISDIEGDAKYGVSTVATKLGARNMTFVVSGVLLLNYLVSISIGIIWPQVFKSNIMILSHAILAFCLIFQTRELALANYASAPSRQFFEFIWLLYYAEYFVYVFI

SEQ ID NO: 212 - DNA, 810 bp, Artificial Sequence
  Artificial truncated geranyl pyrophosphate olivetolic acid geranyltransferase CsPT4_t131 nucleotide sequence
atgtctaacaacagacacttgttctcttggggtttgatgtggaaagctttcttcgctttggtcccaattttgtctttcaatttcttcgccgccatcatgaaccaaatctacgatgttgatatcgaccgtatcaacaagccagacttacctttagtttccggtgaaatgtccattgaaactgcttggatcttgtctatcattgttgccttgactggtttaattgttactattaagttgaagtccgctccattgtttgtcttcatctacatcttcggtatcttcgctggtttcgcttactccgtcccacctattagatggaaacaatatccttttaccaatttcttgatcactatttcctctcatgttggtttggctttcacttcttactctgccaccacttctgctttaggtttgcctttcgtttggcgtcctgccttctctttcattattgctttcatgactgtcatgggtatgactattgcctttgctaaagacatttctgatatcgaaggtgatgctaagtacggtgtctctaccgttgctaccaagttaggtgctagaaatatgacttttgttgtttctggtgtcttattgttgaactacttggtttctatctctattggtatcatttggccacaagttttcaagtctaacattatgatcttgtctcatgctattttggctttctgtttgatctttcaaactcgtgaattagccttagccaattatgcctctgccccatcccgtcaatttttcgaattcatctggttgttatactatgccgaatacttcgtttacgtcttcatttaa

SEQ ID NO: 213 - protein, 269 aa, Artificial Sequence
  Truncated geranyl pyrophosphate olivetolic acid geranyltransferase CsPT4_t131
MSNNRHLFSWGLMWKAFFALVPILSFNFFAAIMNQIYDVDIDRINKPDLPLVSGEMSIETAWILSIIVALTGLIVTIKLKSAPLFVFIYIFGIFAGFAYSVPPIRWKQYPFTNFLITISSHVGLAFTSYSATTSALGLPFVWRPAFSFIIAFMTVMGMTIAFAKDISDIEGDAKYGVSTVATKLGARNMTFVVSGVLLLNYLVSISIGIIWPQVFKSNIMILSHAILAFCLIFQTRELALANYASAPSRQFFEFIWLLYYAEYFVYVFI

SEQ ID NO: 214 - DNA, 777 bp, Artificial Sequence
  Artificial truncated geranyl pyrophosphate olivetolic acid geranyltransferase CsPT4_t142 nucleotide sequence
atgtcttggaaagctttcttcgctttggtcccaattttgtctttcaatttcttcgccgccatcatgaaccaaatctacgatgttgatatcgaccgtatcaacaagccagacttacctttagtttccggtgaaatgtccattgaaactgcttggatcttgtctatcattgttgccttgactggtttaattgttactattaagttgaagtccgctccattgtttgtcttcatctacatcttcggtatcttcgctggtttcgcttactccgtcccacctattagatggaaacaatatccttttaccaatttcttgatcactatttcctctcatgttggtttggctttcacttcttactctgccaccacttctgctttaggtttgcctttcgtttggcgtcctgccttctctttcattattgctttcatgactgtcatgggtatgactattgcctttgctaaagacatttctgatatcgaaggtgatgctaagtacggtgtctctaccgttgctaccaagttaggtgctagaaatatgacttttgttgtttctggtgtcttattgttgaactacttggtttctatctctattggtatcatttggccacaagttttcaagtctaacattatgatcttgtctcatgctattttggctttctgtttgatctttcaaactcgtgaattagccttagccaattatgcctctgccccatcccgtcaatttttcgaattcatctggttgttatactatgccgaatacttcgtttacgtcttcatttaa

SEQ ID NO: 215 - protein, 258 aa, Artificial Sequence
  Truncated geranyl pyrophosphate olivetolic acid geranyltransferase CsPT4_t142
MSWKAFFALVPILSFNFFAAIMNQIYDVDIDRINKPDLPLVSGEMSIETAWILSIIVALTGLIVTIKLKSAPLFVFIYIFGIFAGFAYSVPPIRWKQYPFTNFLITISSHVGLAFTSYSATTSALGLPFVWRPAFSFIIAFMTVMGMTIAFAKDISDIEGDAKYGVSTVATKLGARNMTFVVSGVLLLNYLVSISIGIIWPQVFKSNIMILSHAILAFCLIFQTRELALANYASAPSRQFFEFIWLLYYAEYFVYVFI

SEQ ID NO: 216 - DNA, 705 bp, Artificial Sequence
  Artificial truncated geranyl pyrophosphate olivetolic acid geranyltransferase CsPT4_t166 nucleotide sequence
atgtctgatgttgatatcgaccgtatcaacaagccagacttacctttagtttccggtgaaatgtccattgaaactgcttggatcttgtctatcattgttgccttgactggtttaattgttactattaagttgaagtccgctccattgtttgtcttcatctacatcttcggtatcttcgctggtttcgcttactccgtcccacctattagatggaaacaatatccttttaccaatttcttgatcactatttcctctcatgttggtttggctttcacttcttactctgccaccacttctgctttaggtttgcctttcgtttggcgtcctgccttctctttcattattgctttcatgactgtcatgggtatgactattgcctttgctaaagacatttctgatatcgaaggtgatgctaagtacggtgtctctaccgttgctaccaagttaggtgctagaaatatgacttttgttgtttctggtgtcttattgttgaactacttggtttctatctctattggtatcatttggccacaagttttcaagtctaacattatgatcttgtctcatgctattttggctttctgtttgatctttcaaactcgtgaattagccttagccaattatgcctctgccccatcccgtcaatttttcgaattcatctggttgttatactatgccgaatacttcgtttacgtcttcatttaa

SEQ ID NO: 217 - protein, 234 aa, Artificial Sequence
  Truncated geranyl pyrophosphate olivetolic acid geranyltransferase CsPT4_t166
MSDVDIDRINKPDLPLVSGEMSIETAWILSIIVALTGLIVTIKLKSAPLFVFIYIFGIFAGFAYSVPPIRWKQYPFTNFLITISSHVGLAFTSYSATTSALGLPFVWRPAFSFIIAFMTVMGMTIAFAKDISDIEGDAKYGVSTVATKLGARNMTFVVSGVLLLNYLVSISIGIIWPQVFKSNIMILSHAILAFCLIFQTRELALANYASAPSRQFFEFIWLLYYAEYFVYVFI

SEQ ID NO: 218 - DNA, 645 bp, Artificial Sequence
  Artificial truncated geranyl pyrophosphate olivetolic acid geranyltransferase CsPT4_t186 nucleotide sequence
atgtctattgaaactgcttggatcttgtctatcattgttgccttgactggtttaattgttactattaagttgaagtccgctccattgtttgtcttcatctacatcttcggtatcttcgctggtttcgcttactccgtcccacctattagatggaaacaatatccttttaccaatttcttgatcactatttcctctcatgttggtttggctttcacttcttactctgccaccacttctgctttaggtttgcctttcgtttggcgtcctgccttctctttcattattgctttcatgactgtcatgggtatgactattgcctttgctaaagacatttctgatatcgaaggtgatgctaagtacggtgtctctaccgttgctaccaagttaggtgctagaaatatgacttttgttgtttctggtgtcttattgttgaactacttggtttctatctctattggtatcatttggccacaagttttcaagtctaacattatgatcttgtctcatgctattttggctttctgtttgatctttcaaactcgtgaattagccttagccaattatgcctctgccccatcccgtcaatttttcgaattcatctggttgttatactatgccgaatacttcgtttacgtcttcatttaa

SEQ ID NO: 219 - protein, 214 aa, Artificial Sequence
  Truncated geranyl pyrophosphate olivetolic acid geranyltransferase CsPT4_t186
MSIETAWILSIIVALTGLIVTIKLKSAPLFVFIYIFGIFAGFAYSVPPIRWKQYPFTNFLITISSHVGLAFTSYSATTSALGLPFVWRPAFSFIIAFMTVMGMTIAFAKDISDIEGDAKYGVSTVATKLGARNMTFVVSGVLLLNYLVSISIGIIWPQVFKSNIMILSHAILAFCLIFQTRELALANYASAPSRQFFEFIWLLYYAEYFVYVFI

SEQ ID NO: 220 - DNA, 1188 bp, Artificial Sequence
  Artificial geranyl pyrophosphate olivetolic acid geranyltransferase CsGOT (CsPT1) nucleotide sequence
atgggtttatcttccgtttgtactttttctttccaaactaactaccacactttgttaaatccacacaacaacaaccctaaaacctccttgttatgttacagacacccaaagacccctattaaatactcctacaacaacttcccatccaaacactgctccactaagtcctttcacttgcaaaacaagtgttctgaatccttgtccattgccaagaactctattcgtgccgctactactaaccaaactgagccacctgaatccgataaccactccgtcgccaccaagatcttgaattttggtaaagcttgctggaaattgcaaagaccatacactattattgctttcacttcctgtgcttgtggtttattcggtaaggaattattgcataacaccaacttgatttcttggtccttaatgttcaaagccttcttctttttagttgccattttatgtattgcttctttcactactactattaatcaaatttacgatttgcacattgacagaatcaataagcctgacttgccattagcttccggtgaaatttctgttaacactgcttggatcatgtccatcattgtcgctttgttcggtttaattatcaccatcaaaatgaagggtggtcctttgtacatcttcggttattgcttcggtattttcggtggtattgtctactctgtcccaccattcagatggaagcaaaacccatccactgcctttttgttgaatttcttggctcacatcattaccaattttactttctactatgcctcccgtgctgctttaggtttgccttttgagttacgtccatccttcacttttttattggcttttatgaagtccatgggttctgctttagccttaattaaggacgcctctgacgttgaaggtgatactaagttcggtatctctactttagcctctaagtacggttctcgtaacttgaccttgttctgttctggtattgtcttgttgtcttacgtcgccgctattttggccggtatcatctggccacaagctttcaactctaacgttatgttgttgtctcatgctatcttagctttctggttgatcttacaaaccagagacttcgctttgactaactacgacccagaagccggtcgtagattctacgaattcatgtggaaattgtactacgccgagtacttggtctacgttttcatttag

SEQ ID NO: 221 - DNA, 972 bp, Artificial Sequence
  Artificial truncated geranyl pyrophosphate olivetolic acid geranyltransferase CsPT4t nucleotide sequence
atgtctgctggctctgaccaaattgaaggttccccgcatcacgaatcagataatagtattgccacaaagatcttaaactttgggcatacatgttggaaattacaaaggccctacgtcgtcaaaggaatgataagcatcgcttgcggtctgttcggaagggaattatttaacaataggcatctattcagctgggggttaatgtggaaagctttcttcgcgttagtgccaatcctaagctttaactttttcgccgccatcatgaaccagatttatgatgttgatatcgacaggataaataagccagatcttccattggtatccggtgaaatgtcaatagaaactgcatggatattatctattatcgttgcgctgaccggactgatagtaacaatcaaattgaaatctgcacccctgtttgtttttatatatatatttggtattttcgctggattcgcttactcagtgccacctatcaggtggaagcagtacccattcacgaattttctgatcacgatctctagccacgtcgggttagcgttcacatcttactctgcaaccacgagtgccttggggcttcctttcgtctggcgtccagcttttagttttatcattgcctttatgaccgtaatgggaatgacgatcgcattcgcaaaggacatttctgacatagagggggatgcaaaatacggtgtctccactgtggcgacaaaattaggagctaggaatatgactttcgtggtgtccggtgtattattactaaattatctggtatctataagtatcggcatcatatggccgcaagtgtttaaatccaacattatgatactgagtcatgctattttggctttttgtctgatttttcagacgcgtgagttggcgcttgcaaactatgcctctgcgcccagcaggcagttttttgaattcatatggttattgtactatgccgagtatttcgtctacgtatttatttaa

SEQ ID NO: 222 - DNA, 969 bp, Artificial Sequence
  Artificial truncated geranyl pyrophosphate olivetolic acid geranyltransferase CsGOT_t75 (CsPT1_t75) nucleotide sequence
atgtctgccgctactactaaccaaactgagccacctgaatccgataaccactccgtcgccaccaagatcttgaattttggtaaagcttgctggaaattgcaaagaccatacactattattgctttcacttcctgtgcttgtggtttattcggtaaggaattattgcataacaccaacttgatttcttggtccttaatgttcaaagccttcttctttttagttgccattttatgtattgcttctttcactactactattaatcaaatttacgatttgcacattgacagaatcaataagcctgacttgccattagcttccggtgaaatttctgttaacactgcttggatcatgtccatcattgtcgctttgttcggtttaattatcaccatcaaaatgaagggtggtcctttgtacatcttcggttattgcttcggtattttcggtggtattgtctactctgtcccaccattcagatggaagcaaaacccatccactgcctttttgttgaatttcttggctcacatcattaccaattttactttctactatgcctcccgtgctgctttaggtttgccttttgagttacgtccatccttcacttttttattggcttttatgaagtccatgggttctgctttagccttaattaaggacgcctctgacgttgaaggtgatactaagttcggtatctctactttagcctctaagtacggttctcgtaacttgaccttgttctgttctggtattgtcttgttgtcttacgtcgccgctattttggccggtatcatctggccacaagctttcaactctaacgttatgttgttgtctcatgctatcttagctttctggttgatcttacaaaccagagacttcgctttgactaactacgacccagaagccggtcgtagattctacgaattcatgtggaaattgtactacgccgagtacttggtctacgttttcatttag

SEQ ID NO: 223 - protein, 322 aa, Artificial Sequence
  Truncated geranyl pyrophosphate olivetolic acid geranyltransferase CsGOT_t75 (CsPT1_t75)
MSAATTNQTEPPESDNHSVATKILNFGKACWKLQRPYTIIAFTSCACGLFGKELLHNTNLISWSLMFKAFFFLVAILCIASFTTTINQIYDLHIDRINKPDLPLASGEISVNTAWIMSIIVALFGLIITIKMKGGPLYIFGYCFGIFGGIVYSVPPFRWKQNPSTAFLLNFLAHIITNFTFYYASRAALGLPFELRPSFTFLLAFMKSMGSALALIKDASDVEGDTKFGISTLASKYGSRNLTLFCSGIVLLSYVAAILAGIIWPQAFNSNVMLLSHAILAFWLILQTRDFALTNYDPEAGRRFYEFMWKLYYAEYLVYVFI

SEQ ID NO: 224 - DNA, 972 bp, Artificial Sequence
  Artificial truncated geranyl pyrophosphate olivetolic acid geranyltransferase CsPT4_t76 (CsPT4t) nucleotide sequence
atgtccgccggttctgatcaaatcgaaggttcccctcatcatgagtccgataactccattgctactaaaattttaaatttcggtcatacttgttggaagttgcaacgtccttacgttgtcaagggtatgatctctattgcttgtggtttgttcggtagagaattgtttaacaacagacacttgttctcttggggtttgatgtggaaagctttcttcgctttggtcccaattttgtctttcaatttcttcgccgccatcatgaaccaaatctacgatgttgatatcgaccgtatcaacaagccagacttacctttagtttccggtgaaatgtccattgaaactgcttggatcttgtctatcattgttgccttgactggtttaattgttactattaagttgaagtccgctccattgtttgtcttcatctacatcttcggtatcttcgctggtttcgcttactccgtcccacctattagatggaaacaatatccttttaccaatttcttgatcactatttcctctcatgttggtttggctttcacttcttactctgccaccacttctgctttaggtttgcctttcgtttggcgtcctgccttctctttcattattgctttcatgactgtcatgggtatgactattgcctttgctaaagacatttctgatatcgaaggtgatgctaagtacggtgtctctaccgttgctaccaagttaggtgctagaaatatgacttttgttgtttctggtgtcttattgttgaactacttggtttctatctctattggtatcatttggccacaagttttcaagtctaacattatgatcttgtctcatgctattttggctttctgtttgatctttcaaactcgtgaattagccttagccaattatgcctctgccccatcccgtcaatttttcgaattcatctggttgttatactatgccgaatacttcgtttacgtcttcatttaa

SEQ ID NO: 225 - DNA, 1197 bp, Cannabis sativa
atgggactctcattagtttgtaccttttcatttcaaactaattatcatactttattaaaccctcataataagaatcccaaaaactcattattatcttatcaacaccccaaaacaccaataattaaatcctcttatgataattttccctctaaatattgcttaaccaagaactttcatttacttggactcaattcacacaacagaataagctcacaatcaaggtccattagggcaggtagcgatcaaattgaaggttctcctcatcatgaatctgataattcaatagcaactaaaattttaaattttggacatacttgttggaaacttcaaagaccatatgtagtaaaagggatgatttcaatcgcttgtggtttgtttgggagagagttgttcaataacagacatttattcagttggggtttgatgtggaaggcattctttgctttggtgcctatattgtccttcaatttctttgcagcaatcatgaatcaaatttacgatgtggacatcgacaggataaacaagcctgatctaccactagtttcaggggaaatgtcaattgaaacagcttggattttgagcataattgtggcactaactgggttgatagtaactataaaattgaaatctgcaccactttttgttttcatttacatttttggtatatttgctgggtttgcctattctgttccaccaattagatggaagcaatatccttttaccaattttctaattaccatatcgagtcatgtgggcttagctttcacatcatattctgcaaccacatcagctcttggtttaccatttgtgtggaggcctgcttttagtttcatcatagcattcatgacagttatgggtatgactattgcttttgccaaagatatttcagatattgaaggcgacgccaaatatggggtatcaactgttgcaaccaaattaggtgctaggaacatgacatttgttgtttctggagttcttcttctaaactacttggtttctatatctattgggataatttggcctcaggttttcaagagtaacataatgatactttctcatgcaatcttagcattttgcttaatcttccagactcgtgagcttgctctagcaaattacgcctcggcgccaagcagacaattcttcgagtttatctggttgctatattatgctgaatactttgtatatgtatttatataa

What is claimed is:

1. A genetically modified yeast cell for producing a cannabinoid or a cannabinoid derivative, the genetically modified yeast cell comprising one or more heterologous nucleic acids integrated into a chromosome of the genetically modified yeast cell and encoding a geranyl pyrophosphate:olivetolic acid geranyltransferase polypeptide comprising the amino acid sequence of SEQ ID NO:110 or SEQ ID NO:100.

2. The genetically modified yeast cell of claim 1, wherein the genetically modified yeast cell further comprises one or more heterologous nucleic acids integrated into a chromosome of the genetically modified yeast cell and encoding a tetraketide synthase (TKS) polypeptide comprising the amino acid sequence of SEQ ID NO:11 and one or more heterologous nucleic acids integrated into a chromosome of the genetically modified yeast cell and encoding an olivetolic acid cyclase (OAC) polypeptide comprising the amino acid sequence of SEQ ID NO:10.

3. The genetically modified yeast cell of claim 1, wherein the genetically modified yeast cell further comprises one or more of the following:
   a) one or more heterologous nucleic acids encoding a polypeptide that generates an acyl-CoA compound or an acyl-CoA compound derivative, wherein the polypeptide that generates an acyl-CoA compound or an acyl-CoA compound derivative is an acyl-activating enzyme (AAE) polypeptide comprising the amino acid sequence of SEQ ID NO:90, SEQ ID NO:92, or SEQ ID NO:149; a fatty acyl-CoA ligase polypeptide comprising the amino acid sequence of SEQ ID NO:145 or SEQ ID NO:147; or a fatty acyl-CoA synthetase (FAA) polypeptide comprising the amino acid sequence of SEQ ID NO:169, SEQ ID NO:192, SEQ ID NO:194, SEQ ID NO:196, SEQ ID NO:198, or SEQ ID NO:200; or
   b) one or more heterologous nucleic acids encoding a polypeptide that generates geranyl pyrophosphate, wherein the polypeptide that generates geranyl pyrophosphate is a geranyl pyrophosphate synthetase (GPPS) polypeptide comprising the amino acid sequence of SEQ ID NO:60.

4. The genetically modified yeast cell of claim 1, wherein the genetically modified yeast cell further comprises one or more of the following:
   a) one or more heterologous nucleic acids encoding a HMG-CoA synthase (HMGS) polypeptide comprising the amino acid sequence of SEQ ID NO:115;
   b) one or more heterologous nucleic acids encoding a 3-hydroxy-3-methyl-glutaryl-CoA reductase (HMGR) polypeptide comprising the amino acid sequence SEQ ID NO:208;
   c) one or more heterologous nucleic acids encoding a mevalonate kinase (MK) polypeptide comprising the amino acid sequence of SEQ ID NO:64;
   d) one or more heterologous nucleic acids encoding a phosphomevalonate kinase (PMK) polypeptide comprising the amino acid sequence of SEQ ID NO:205;
   e) one or more heterologous nucleic acids encoding a mevalonate pyrophosphate decarboxylase (MVD) polypeptide comprising the amino acid sequence of SEQ ID NO:66; or
   f) one or more heterologous nucleic acids encoding a isopentenyl diphosphate isomerase (IDI) polypeptide comprising the amino acid sequence of SEQ ID NO:58.

5. The genetically modified yeast cell of claim 4, wherein the genetically modified yeast cell further comprises one or more heterologous nucleic acids encoding a polypeptide that condenses two molecules of acetyl-CoA to generate acetoacetyl-CoA and wherein the polypeptide that condenses two molecules of acetyl-CoA to generate acetoacetyl- CoA is an acetoacetyl-CoA thiolase polypeptide comprising the amino acid sequence of SEQ ID NO:25.

6. The genetically modified yeast cell of claim 1, wherein the yeast cell is *Saccharomyces cerevisiae*.

7. The genetically modified yeast cell of claim 1, wherein the genetically modified yeast cell further comprises one or more heterologous nucleic acids encoding a cannabinoid synthase polypeptide, wherein the cannabinoid synthase polypeptide is a tetrahydrocannabinolic acid (THCA) synthase polypeptide comprising the amino acid sequence of SEQ ID NO:155 or a cannabidiolic acid (CBDA) synthase polypeptide comprising the amino acid sequence of SEQ ID NO:88 or SEQ ID NO:151.

8. The genetically modified yeast cell of claim 1, wherein the genetically modified yeast cell further comprises one or more of the following:
   a) one or more heterologous nucleic acids encoding a polypeptide that generates an acyl-CoA compound or an acyl-CoA compound derivative, wherein the polypeptide that generates an acyl-CoA compound or an acyl-CoA compound derivative is an acyl-activating enzyme (AAE) polypeptide comprising the amino acid sequence of SEQ ID NO:90, SEQ ID NO:92, or SEQ ID NO:149; a fatty acyl-CoA ligase polypeptide comprising the amino acid sequence of SEQ ID NO:145 or SEQ ID NO:147; or a fatty acyl-CoA synthetase (FAA) polypeptide comprising the amino acid sequence of SEQ ID NO:169, SEQ ID NO:192, SEQ ID NO:194, SEQ ID NO:196, SEQ ID NO:198, or SEQ ID NO:200;
   b) one or more heterologous nucleic acids encoding a polypeptide that generates geranyl pyrophosphate, wherein the polypeptide that generates geranyl pyrophosphate is a geranyl pyrophosphate synthetase (GPPS) polypeptide comprising the amino acid sequence of SEQ ID NO:60;
   c) one or more heterologous nucleic acids encoding a HMG-CoA synthase (HMGS) polypeptide comprising the amino acid sequence of SEQ ID NO:115;
   d) one or more heterologous nucleic acids encoding a 3-hydroxy-3-methyl-glutaryl-CoA reductase (HMGR) polypeptide comprising the amino acid sequence of SEQ ID NO:208;
   e) one or more heterologous nucleic acids encoding a mevalonate kinase (MK) polypeptide comprising the amino acid sequence of SEQ ID NO:64;
   f) one or more heterologous nucleic acids encoding a phosphomevalonate kinase (PMK) polypeptide comprising the amino acid sequence of SEQ ID NO:205;
   g) one or more heterologous nucleic acids encoding a mevalonate pyrophosphate decarboxylase (MVD) polypeptide comprising the amino acid sequence of SEQ ID NO:66;
   h) one or more heterologous nucleic acids encoding a isopentenyl diphosphate isomerase (IDI) polypeptide comprising the amino acid sequence of SEQ ID NO:58;
   i) one or more heterologous nucleic acids encoding a polypeptide that condenses two molecules of acetyl-CoA to generate acetoacetyl-CoA, wherein the polypeptide that condenses two molecules of acetyl-CoA to generate acetoacetyl-CoA is an acetoacetyl-CoA thiolase polypeptide comprising the amino acid sequence of SEQ ID NO:25; or
   j) one or more heterologous nucleic acids integrated into a chromosome of the genetically modified yeast cell and encoding a tetraketide synthase (TKS) polypeptide comprising the amino acid sequence of SEQ ID NO:11 and one or more heterologous nucleic acids integrated into a chromosome of the genetically modified yeast cell and encoding an olivetolic acid cyclase (OAC) polypeptide comprising the amino acid sequence of SEQ ID NO:10.

9. A method of producing a cannabinoid or a cannabinoid derivative, the method comprising:
   a) culturing a genetically modified yeast cell comprising:
      i) one or more heterologous nucleic acids integrated into a chromosome of the genetically modified yeast cell and encoding a geranyl pyrophosphate:olivetolic acid geranyltransferase polypeptide comprising the amino acid sequence of SEQ ID NO:110 or SEQ ID NO:100; and
      ii) one or more heterologous nucleic acids integrated into a chromosome of the genetically modified yeast cell and encoding a tetraketide synthase (TKS) polypeptide comprising the amino acid sequence of SEQ ID NO:11; and/or
      iii) one or more heterologous nucleic acids integrated into a chromosome of the genetically modified yeast cell and encoding an olivetolic acid cyclase (OAC) polypeptide comprising the amino acid sequence of SEQ ID NO:10;
      in a suitable medium containing a carboxylic acid; and
   b) recovering the produced cannabinoid or cannabinoid derivative.

10. The method of claim 9, wherein the carboxylic acid is hexanoic acid or a hexanoic acid derivative, butyric acid or a butyric acid derivative, or valeric acid or a valeric acid derivative.

11. The method of claim 9, wherein the cannabinoid is cannabigerolic acid, cannabigerolic acid monomethylether (CBGAM), cannabigerol, $\Delta^9$-trans-tetrahydrocannabinol, $\Delta^9$-tetrahydrocannabinolic acid, $\Delta^9$-tetrahydrocannabinolic acid A, $\Delta^9$-tetrahydrocannabinolic acid B, $\Delta^9$-tetrahydrocannabinolic acid $C_4$, $\Delta^9$-tetrahydrocannabinol $C_4$, $\Delta^9$-tetrahydrocannabivarinic acid $C_4$, $4^9$-tetrahydrocannabivarin, $\Delta^9$-tetrahydrocannabiorcolic acid, $\Delta^9$-tetrahydrocannabiorcol, $\Delta^7$-cis-iso-tetrahydrocannabivarin, $\Delta^9$-tetrahydrocannabinol, $\Delta^8$-tetrahydrocannabinolic acid, $\Delta^8$-trans-tetrahydrocannabinol, $\Delta^8$-tetrahydrocannabinol, cannabidiolic acid, cannabidiol, cannabidiol monomethylether (CBDM), cannabidiol-$C_4$ (CBD-$C_4$), cannabidiorcol (CBD-$C_1$), cannabitriol, cannabichromenic acid, cannabichromene, cannabinolic acid, cannabinol, cannabinol methylether, cannabinol-C4, cannabinol-C2, cannabidivarinic acid, cannabidivarin, tetrahydrocannabivarinic acid, tetrahydrocannabivarin, cannabichromevarinic acid, cannabichromevarin, cannabigerovarinic acid, cannabigerovarin, cannabicyclolic acid, cannabicyclol, cannabicyclovarin, cannabielsoic acid A, cannabielsoic acid B, cannabielsoinic acid, cannabielsoin, cannabicitranic acid, or cannabicitran.

12. The method of claim 10, wherein the carboxylic acid is hexanoic acid and wherein the cell culture produces the cannabinoid or cannabinoid derivative at a concentration of about 15 mg/L to about 500 mg/L.

13. A method of producing a cannabinoid or cannabinoid derivative, the method comprising:
   a) culturing a genetically modified yeast cell comprising:
      i) one or more heterologous nucleic acids integrated into a chromosome of the genetically modified yeast cell and encoding a geranyl pyrophosphate:olivetolic acid geranyltransferase polypeptide comprising the amino acid sequence of SEQ ID NO:110 or SEQ ID NO:100;
      ii) one or more heterologous nucleic acids integrated into a chromosome of the genetically modified yeast cell and encoding a tetraketide synthase (TKS) polypeptide comprising the amino acid sequence of SEQ ID NO:11;

iii) one or more heterologous nucleic acids integrated into a chromosome of the genetically modified yeast cell and encoding an olivetolic acid cyclase (OAC) polypeptide comprising the amino acid sequence of SEQ ID NO:10;

iv) one or more heterologous nucleic acids encoding a THCA synthase polypeptide comprising the amino acid sequence of SEQ ID NO:155 or a CBDA synthase polypeptide comprising the amino acid sequence of SEQ ID NO:88 or SEQ ID NO:151;

v) one or more heterologous nucleic acids encoding one or more polypeptides that generate geranyl pyrophosphate, wherein the polypeptide that generates geranyl pyrophosphate is a geranyl pyrophosphate synthetase (GPPS) polypeptide comprising the amino acid sequence of SEQ ID NO:60;

vi) one or more heterologous nucleic acids encoding one or more polypeptides that generate an acyl-CoA compound or an acyl-CoA compound derivative wherein the polypeptide that generates an acyl-CoA compound or an acyl-CoA compound derivative is an acyl-activating enzyme (AAE) polypeptide comprising the amino acid sequence of SEQ ID NO:90, SEQ ID NO:92, or SEQ ID NO:149; a fatty acyl-CoA ligase polypeptide comprising the amino acid sequence of SEQ ID NO:145 or SEQ ID NO:147; or a fatty acyl-CoA synthetase (FAA) polypeptide comprising the amino acid sequence of SEQ ID NO:169, SEQ ID NO:192, SEQ ID NO:194, SEQ ID NO:196, SEQ ID NO:198, or SEQ ID NO:200; and vii) one or more heterologous nucleic acids encoding one or more polypeptides that generate malonyl-CoA, wherein the polypeptide that generates malonyl-CoA is an acetyl-CoA carboxylase-1 (ACC1) polypeptide comprising the amino acid sequence of SEQ ID NO:9, SEQ ID NO:97, or SEQ ID NO:207;

in a suitable medium; and b) recovering the produced cannabinoid or cannabinoid derivative.

14. The method of claim 13, wherein at least one of the heterologous nucleic acids integrated into a chromosome of the genetically modified yeast cell is operably linked to an inducible promoter.

15. A method of producing a cannabinoid or a cannabinoid derivative, the method comprising use of a genetically modified yeast cell comprising a heterologous nucleic acid integrated into a chromosome of the genetically modified yeast cell and encoding a geranyl pyrophosphate:olivetolic acid geranyltransferase polypeptide comprising the amino acid sequence of SEQ ID NO:110 or SEQ ID NO:100.

* * * * *